US012760326B2

(12) United States Patent
Mali et al.

(10) Patent No.: US 12,760,326 B2
(45) Date of Patent: Oct. 13, 2026

(54) RNA AND DNA BASE EDITING VIA ENGINEERED ADAR

(71) Applicant: The Regents of the University of California, Oakland, CA (US)

(72) Inventors: Prashant Mali, La Jolla, CA (US); Dhruva Katrekar, La Jolla, CA (US); Nathan Palmer, La Jolla, CA (US)

(73) Assignee: The Regents of the University of California, Oakland, CA (US)

( * ) Notice: Subject to any disclaimer, the term of this patent is extended or adjusted under 35 U.S.C. 154(b) by 703 days.

(21) Appl. No.: 18/025,169

(22) PCT Filed: Sep. 8, 2021

(86) PCT No.: PCT/US2021/049530

§ 371 (c)(1),
(2) Date: Mar. 7, 2023

(87) PCT Pub. No.: WO2022/056041

PCT Pub. Date: Mar. 17, 2022

(65) Prior Publication Data

US 2023/0313231 A1 Oct. 5, 2023

Related U.S. Application Data

(60) Provisional application No. 63/075,717, filed on Sep. 8, 2020.

(51) Int. Cl.

| | |
|---|---|
| ***C12N 9/22*** | (2006.01) |
| ***C12N 9/78*** | (2006.01) |
| ***C12N 15/11*** | (2006.01) |
| ***C12N 15/86*** | (2006.01) |
| ***C12N 15/87*** | (2006.01) |

(52) U.S. Cl.

CPC ............... *C12N 15/87* (2013.01); *C12N 9/22* (2013.01); *C12N 9/78* (2013.01); *C12N 15/11* (2013.01); *C12N 15/111* (2013.01); *C12N 15/86* (2013.01); *C12Y 305/04004* (2013.01); *C12N 2320/33* (2013.01); *C12N 2750/14143* (2013.01)

(58) Field of Classification Search

None

See application file for complete search history.

(56) References Cited

FOREIGN PATENT DOCUMENTS

| | | | |
|---|---|---|---|
| WO | WO-2018161032 A1 * | 9/2018 | ............. A61P 21/00 |
| WO | 2019/104094 A2 | 5/2019 | |

OTHER PUBLICATIONS

Katrekar et al., "In vivo RNA editing of point mutations via RNA-guided adenosine deaminases," Nature Methods, 16(3):239-242, Mar. 2019.
Niebuhr-Ebel, K., International Search Report and Written Opinion, European Patent Office, PCT/US2021/049530, Feb. 11, 2022.
Wang et al., "A Phenotypic Screen for Functional Mutants of Human Adenosine Deaminase Acting on RNA 1," ACS Chemical Biol., 10(11): 2512-2519, Nov. 2015.
UniProt, "Adenosine deaminase RNA specific B1 from Western Loland gorilla," UniProt Accession G3RBQ6, 2011.
Bass, B. L., "RNA Editing by Adenosine Deaminases that Act on RNA", Annual Review of Biochemistry, Jul. 2002, 71(1), 817-846.
Casey, J. L., "Control of ADAR1 Editing of Hepatitis Delta virus RNAs", Adenosine Deaminases Acting on RNA (ADARs) and A-to-I Editing, Jan. 1, 2011, 123-143.
Chang, J., Sigal, L. J., Lerro, A., & Taylor, J., "Replication of the Human Hepatitis Delta Virus Genome is Initiated in Mouse Hepatocytes Following Intravenous Injection of Naked DNA or RNA Sequences", Journal of Virology, Apr. 1, 2001, 75(7), 3469-3473.
Gallo, A., & Locatelli, F., "ADARs: allies or enemies? The importance of A-to-I RNA editing in human disease: from cancer to HIV-1", Biological Reviews, Jun. 20, 2011, 87(1), 95-110.
Modahl, L. E., & Lai, M. M., "Transcription of Hepatitis Delta Antigen mRNA Continues throughout Hepatitis Delta Virus (HDV) Replication: a New Model of HDV RNA Transcription and Replication", Journal of Virology, Jul. 1, 1998, 72(7), 5449-5456.
Nishikura, K., "Editor meets silencer: crosstalk between RNA editing and RNA interference", Nature Reviews Molecular and Cellular Biology, Dec. 1, 2006, 7, 919-31.
Nishikura, K., "Functions and Regulation of RNA Editing by ADAR Deaminases", Annual Review of Biochemistry Jul. 7, 2010, 79, 321-49.
Lindner, Nora, International Preliminary Report on Patentability and Written Opinion, The International Bureau of WIPO, PCT/US2021/049530, Mar. 23, 2023.

* cited by examiner

*Primary Examiner* — Richard G Hutson
(74) *Attorney, Agent, or Firm* — Gavrilovich, Dodd & Lindsey LLP

(57) ABSTRACT

Disclosed herein are engineered ADAR systems for gene editing.

28 Claims, 28 Drawing Sheets

Specification includes a Sequence Listing.

ADAR2 DD

1↓
316- QLHLPQVLADAVSRLVLGKFGDLTDNFS
2↓ 3↓
SPHARRKVLAGVVMTTGTDVKDAKVISV
4↓
STGTKCINGEYMSDRGLALNDCHAEIIS
5↓ 6↓
RRSLLRFLYTQLELYLNNKDDQKRSIFQ
7↓ 8↓
KSERGGFRLKENVQFHLYISTSPCGDAR
9↓↓↓↓12 13↓ 14↓
IFSPHEPILEEPADRHPNRKARGQLRTK
15↓ 16↓ 17↓ 18↓
IESGEGTIPVRSNASIQTWDGVLQGERL
LTMSCSDKIARWNVVGIQGSLLSIFVEP
IYFSSIILGSLYHGDHLSRAMYQRISNI
EDLPPLYTLNKPLLSGISNAEARQPGKA
PNFSVNWTVGDSAIEVINATTGKDELGR
ASRLCKHALYCRWMRVHGKVPSHLLRSK
ITKPNVYHESKLAAKEYQAAKARLFTAF
IKAGLGANVEKPTEQDQFSLTP -701

*FIG. 3B*

RNA AND DNA BASE EDITING VIA ENGINEERED ADAR

CROSS-REFERENCE TO RELATED APPLICATIONS

This application is a U.S. National Phase Application filed under 35 U.S.C. § 371 and claims priority to International Appl. No. PCT/US2021/049530, filed Sep. 8, 2021, which application claims the benefit of U.S. Provisional Appl. No. 63/075,717, filed Sep. 8, 2020, the disclosures of which are incorporated by reference herein in their entirety.

STATEMENT REGARDING GOVERNMENT SUPPORT

This disclosure was made with government support under grant numbers CA222826, GM123313, and HG009285 awarded by the National Institutes of Health. The government has certain rights in the invention.

TECHNICAL FIELD

The disclosure relates to engineered adenosine deaminases acting on RNA (ADAR) and methods of use thereof.

INCORPORATION BY REFERENCE OF SEQUENCE LISTING

Accompanying this filing is a Sequence Listing entitled, "Sequence-Listing_ST25" created on Apr. 20, 2026 and having 673,293 bytes of data, machine formatted on IBM-PC, MS-Windows operating system. The sequence listing is hereby incorporated by reference in its entirety for all purposes.

BACKGROUND

Adenosine to inosine (A-to-I) editing is a post-transcriptional modification in RNA that occurs in a variety of organisms, including humans. This A-to-I deamination of specific adenosines in double-stranded RNA is catalyzed by enzymes called adenosine deaminases acting on RNA (ADARs). Since inosine is structurally similar to guanosine, it is interpreted as a guanosine during the cellular processes of translation and splicing.

SUMMARY

Adenosine deaminases acting on RNA (ADARs) can be repurposed to enable programmable RNA editing, however their exogenous delivery may lead to transcriptome-wide off-targeting, and additionally, enzymatic activity on certain RNA motifs, especially those flanked by a 5' guanosine may be very low thus limiting their utility as a transcriptome engineering toolset. To address this, a comprehensive ADAR2 protein engineering techniques were undertaken via three approaches: First, a deep mutational scan of the deaminase domain that enabled direct coupling of variants to corresponding RNA editing activity was performed. Experimentally measuring the impact of every amino acid substitution across 261 residues, ~5000 variants, on RNA editing, revealed intrinsic domain properties, and also several mutations that greatly enhanced RNA editing. Second, a domain-wide mutagenesis screen was performed to identify variants that increased activity at 5'-GA-3' motifs, and discovered novel mutants that enabled robust RNA editing. Third, the domain was engineered at the fragment level to create split deaminases. Notably, compared to full-length deaminase overexpression, split-deaminases resulted in >1000 fold more specific RNA editing.

The disclosure provides an isolated polypeptide comprising a sequence selected from the group consisting of: (i) a sequence that is at least 85% identical to SEQ ID NO:2 and having a $E488X_1$ mutation and a $N496X_2$ mutation, wherein $X_1$ is Q, H, R, K, N, A, M, S, F, L, or W and $X_2$ is F or Y or a catalytic domain thereof and wherein the polypeptide performs a chemical modification to a nucleotide; (ii) a sequence of SEQ ID NO:2 and having a $E488X_1$ mutation and a $N496X_2$ mutation, wherein $X_1$ is Q, H, R, K, N, A, M, S, F, L, or W and $X_2$ is F or Y or a catalytic domain and wherein the polypeptide performs a chemical modification to a nucleotide; (iii) a sequence that is at least 85% identical SEQ ID NO:2 from amino acid 316-697 and having a $E488X_1$ mutation and a $N496X_2$ mutation, wherein $X_1$ is Q, H, R, K, N, A, M, S, F, L, or W and $X_2$ is F or Y or a catalytic domain and wherein the polypeptide performs a chemical modification to a nucleotide; and (iv) a sequence of SEQ ID NO:2 from amino acid 316-697 and having a $E488X_1$ mutation and a $N496X_2$ mutation, wherein $X_1$ is Q, H, R, K, N, A, M, S, F, L, or W and $X_2$ is F or Y or a catalytic domain and wherein the polypeptide performs a chemical modification to a nucleotide. In one embodiment, the isolated polypeptide further comprises one or more additional mutations selected from the group consisting of: G336D, G487A, G487V, T490C, T490S, V493T, V493S, V493A, V493R, V493D, V493P, V493G, N597K, N597R, N597A, N597E, N597H, N597G, N597Y, A589V, S599T, N613K, N613R, N613A, and N613E of SEQ ID NO:2. In another embodiment, the isolated polypeptide further comprises one or more additional mutations at R348, V351, T375, K376, E396, C451, R455, N473, R474, K475, R477, R481, S486, T490, S495, and/or R510.

The disclosure provides an isolated polypeptide comprising a sequence selected from the group consisting of: (i) a sequence that is at least 85%, 87%, 90%, 92%, 95%, 98%, or 99% identical to SEQ ID NO:4 and having a $E1008X_1$ mutation and a $S1016X_2$ mutation, wherein $X_1$ is Q, H, R, K, N, A, M, S, F, L, or W and $X_2$ is F or Y or a catalytic domain and wherein the polypeptide performs a chemical modification to a nucleotide; (ii) a sequence of SEQ ID NO:4 and having a $E1008X_1$ mutation and a $S1016X_2$ mutation, wherein $X_1$ is Q, H, R, K, N, A, M, S, F, L, or W and $X_2$ is F or Y or a catalytic domain and wherein the polypeptide performs a chemical modification to a nucleotide; (iii) a sequence that is at least 85%, 87%, 90%, 92%, 95%, 98%, or 99% identical SEQ ID NO:4 from amino acid 886-1221 and having a $E1008X_1$ mutation and a $S1016X_2$ mutation, wherein $X_1$ is Q, H, R, K, N, A, M, S, F, L, or W and $X_2$ is F or Y or a catalytic domain and wherein the polypeptide performs a chemical modification to a nucleotide; and (iv) a sequence of SEQ ID NO:4 from amino acid 886-1221 and having a $E1008X_1$ mutation and a $S1016X_2$ mutation, wherein $X_1$ is Q, H, R, K, N, A, M, S, F, L, or W and $X_2$ is F or Y or a catalytic domain and wherein the polypeptide performs a chemical modification to a nucleotide.

The disclosure provides a composition comprising an isolated polypeptide of the disclosure and a polynucleotide.

The disclosure also provides an isolated polynucleotide encoding the polypeptide as described herein. In one embodiment, the polynucleotide hybridizes under moderate to stringent conditions to polynucleotide consisting of SEQ ID NO:1 or 3. The disclosure also provides a vector comprising the isolated polynucleotide of the disclosure. The disclosure provides a host cell comprising a polynucleotide of the disclosure or a vector of the disclosure.

The disclosure provides a recombinant polypeptide having a sequence that is at least 85% identical to SEQ ID NO:2 from about amino acid 316 to 465, 466, 467, 468, or 469. In one embodiment, the polypeptide comprises a sequence that is at least 85% identical to SEQ ID NO: 10. In another or further embodiment, the polypeptide is at least 85% identical to SEQ ID NO: 10 and has a E21$X_1$ mutation and a N29$X_2$ mutation, wherein $X_1$ is Q, H, R, K, N, A, M, S, F, L, or W and $X_2$ is F or Y. In still another or further embodiment the polypeptide comprises a tethering moiety. In a further embodiment, the tethering moiety comprises a MS2 coat protein peptide, a PP7 peptide, a LambdaN peptide, a tet peptide, a Cas protein or a programmable PUF domain.

The disclosure provides a recombinant polypeptide having a sequence that is at least 85% identical to SEQ ID NO:2 from about amino acid 466, 467, 468, 469, or 470 to amino acid 701. In one embodiment, the polypeptide comprises a sequence that is at least 85% identical to SEQ ID NO:8. In another or further embodiment, the polypeptide comprises a tethering moiety. In a further embodiment, the tethering moiety comprises a MS2 coat protein peptide, a PP7 peptide, a LambdaN peptide, a tet peptide, a Cas protein or a programmable PUF domain.

The disclosure provides an isolated polynucleotides) encoding a polypeptide as described above. The disclosure further provides at least one vector comprising the polynucleotides as well as host cells comprising the polynucleotide(s) or vector(s).

The disclosure provides an engineered, non-naturally occurring system suitable for modifying a target RNA, comprising: a first polypeptide having a sequence that is at least 85% identical to SEQ ID NO:10 and has a E21$X_1$ mutation and a N29$X_2$ mutation, wherein $X_1$ is Q, H, R, K, N, A, M, S, F, L, or W and $X_2$ is F or Y, operably linked to a first tethering moiety or a nucleotide sequence encoding the first polypeptide operably linked to a first tethering moiety; a second polypeptide having a sequence that is at least 85% identical to SEQ ID NO:8 operably linked to a second tethering moiety or a nucleotide sequence encoding the second polypeptide operably linked to the second tethering moiety; and a guide RNA comprising a guide sequence having a degree of complementarity with a target RNA that comprises an adenine or cytidine and having at a first end a cognate to the first tethering moiety and at the opposite second end a cognate to the second tethering moiety; wherein said first and second polypeptide interact with the guide RNA at the target RNA to modify the target RNA.

The disclosure provides an engineered, non-naturally occurring system suitable for modifying a target RNA, comprising: a polypeptide of the disclosure (e.g., any of SEQ ID Nos:29-98) or catalytic domain thereof, or a nucleotide sequence encoding the polypeptide or catalytic domain thereof; and a guide RNA comprising a guide sequence having a degree of complementarity with a target RNA that comprises an adenine or cytidine; wherein said polypeptide or catalytic domain thereof interacts with the guide RNA at the target RNA to modify the target RNA. In one embodiment, the guide RNA comprises a non-pairing nucleotide at a position corresponding to said adenosine or cytidine resulting in a mismatch in a double stranded substrate formed between the guide RNA and the target RNA. In another embodiment, the system comprises one or more vectors comprising: (i) a first regulatory element operably linked to a nucleotide sequence encoding the guide molecule; (ii) a second regulatory element operably linked to a nucleotide sequence encoding the first polypeptide; and (iii) an optional third regulatory element operably linked to a nucleotide sequence encoding the second polypeptide, wherein the nucleotide sequence encoding the second polypeptide is under control of the second or third regulatory element. In yet a further embodiment, the nucleotide sequence encoding the first polypeptide and the nucleotide sequence encoding the second polypeptide are separated by a linker sequence encoding a cleavable peptide. In still another or further embodiment, the cleavable peptide is a 2A or 2A-like peptide sequence. In still another embodiment, the first polypeptide, second polypeptide are fused to the first tethering moiety and second tethering moiety, respectively, by a linker. In yet another embodiment, the first and second tethering moieties are independently selected from the group consisting of MS2, Cas, PP7, Qβ, F2, GA, fr, JP501, M12, R17, BZ13, JP34, JP500, KU1, M11, MX1, TW18, VK, SP, FI, ID2, NL95, TW19, AP205, φCb5, φCb8r, φCb12r, φCb23r, 7s and PRR1 and wherein the first and second tethering moieties are not the same. In still another or further embodiment, the guide sequence has a length of from about 10 to about 100 nucleotides. In still another or further embodiment, the polypeptide, first polypeptide and/or second polypeptide further comprises one or more nuclear export signal(s) (NES(s)) or nuclear localization signal(s) (NLS(s)).

The disclosure also provides a method of modifying a protein encoded by a target RNA comprising: contacting the target RNA with a system of the disclosure (e.g., comprising a recombinant ADAR or split ADAR system). In one embodiment, the modifying of the protein treat or prevents a disease or disorder. In a further embodiment, the disease is selected from cystic fibrosis, albinism, alpha-1-antitrypsin deficiency, Alzheimer disease, Amyotrophic lateral sclerosis, Asthma, β-thalassemia, Cadasil syndrome, Charcot-Marie-Tooth disease, Chronic Obstructive Pulmonary Disease (COPD), Distal Spinal Muscular Atrophy (DSMA), Duchenne/Becker muscular dystrophy, Dystrophic Epidermolysis bullosa, Epidermylosis bullosa, Fabry disease, Factor V Leiden associated disorders, Familial Adenomatous, Polyposis, Galactosemia, Gaucher's Disease, Glucose-6-phosphate dehydrogenase, Haemophilia, Hereditary Hematochromatosis, Hunter Syndrome, Huntington's disease, Hurler Syndrome, Inflammatory Bowel Disease (IBD), Inherited polyagglutination syndrome, Leber congenital amaurosis, Lesch-Nyhan syndrome, Lynch syndrome, Marfan syndrome, Mucopolysaccharidosis, Muscular Dystrophy, Myotonic dystrophy types I and II, neurofibromatosis, Niemann-Pick disease type A, B and C, NY-esol related cancer, Parkinson's disease, Peutz-Jeghers Syndrome, Phenylketonuria, Pompe's disease, Primary Ciliary Disease, Prothrombin mutation related disorders, such as the Prothrombin G20210A mutation, Pulmonary Hypertension, Retinitis Pigmentosa, Sandhoff Disease, Severe Combined Immune Deficiency Syndrome (SCID), Sickle Cell Anemia, Spinal Muscular Atrophy, Stargardt's Disease, Tay-Sachs Disease, Usher syndrome, X-linked immunodeficiency, various forms of cancer (e.g. BRCA1 and 2 linked breast cancer and ovarian cancer), an ornithine transcarbamylase deficiency, Alzheimer's disease, pain, and Rett syndrome.

The disclosure also provides a method for modifying a target site within a DNA-RNA hybrid molecule, the method comprising contacting the hybrid molecule with an adenosine deaminase that acts on RNA (ADAR), wherein the ADAR comprises a recombinant, engineered or split ADAR polypeptide system of the disclosure. In one embodiment, the ADAR comprises an ADAR catalytic domain of SEQ ID NO:2 from amino acid 316 to 701. In another embodiment, modifying the target site comprises modifying the DNA strand of the hybrid molecule.

The disclosure provides a composition comprising (i) a first fusion protein comprising a polypeptide comprising a portion of an ADAR catalytic domain of the disclosure operably linked to a first tethering moiety and a second fusion protein comprising a second portion of an ADAR catalytic domain of the disclosure operably linked to a second tethering moiety, or (ii) at least one polynucleotide encoding (i); wherein the first and second tethering moieties are different.

The disclosure provides an isolated polypeptide comprising an amino acid sequence with a first mutation at position 488 of SEQ ID NO:2 and a second mutation at position 496 of SEQ ID NO:2, wherein the first mutation is a Q, H, R, K, N, A, M, S, F, L, or W mutation and the second mutation is an F or Y mutation, wherein excluding the first mutation and the second mutation, the polypeptide has at least about 85% sequence identity to SEQ ID NO:2, and wherein the polypeptide deaminates an adenosine in a nucleotide of a double stranded nucleic acid substrate, as determined by an in vitro assay.

The disclosure provides an isolated polypeptide comprising an amino acid sequence with a first mutation at position 1008 of SEQ ID NO:4 and a second mutation at position 1016 of SEQ ID NO:4, wherein the first mutation is a Q, H, R, K, N, A, M, S, F, L, or W mutation and the second mutation is an F or Y mutation, wherein excluding the first mutation and the second mutation, the polypeptide has at least about 85% sequence identity to SEQ ID NO:4, and wherein the polypeptide deaminates an adenosine in a nucleotide of a double stranded nucleic acid substrate, as determined by an in vitro assay.

BRIEF DESCRIPTION OF THE DRAWINGS

FIG. 3A-D shows (A) Schematic of the split-ADAR2 engineering approach. (B) Sequence of the ADAR2-DD (SEQ ID NO:2 from amino acid 316 to 701). The protein was split between residues labelled in red, and a total of 18 pairs were evaluated. (C) The ability of each split pair from (B) to correct a premature stop codon when transfected with a chimeric BoxB-MS2 adRNA was assayed via a luciferase assay. The pairs 1-18 correspond to the residues in red in (B) in the order in which they appear. The residues in (B) in bold red correspond to pairs 9-12. Values represent mean (n=2). (D) Engineering of humanized split-ADAR2 variant based on pair 12 and assayed of its ability to correct a stop codon in the cluc transcript. Values represent mean (n=2). All experiments were carried out in HEK293FT cells.

Figure 1A:
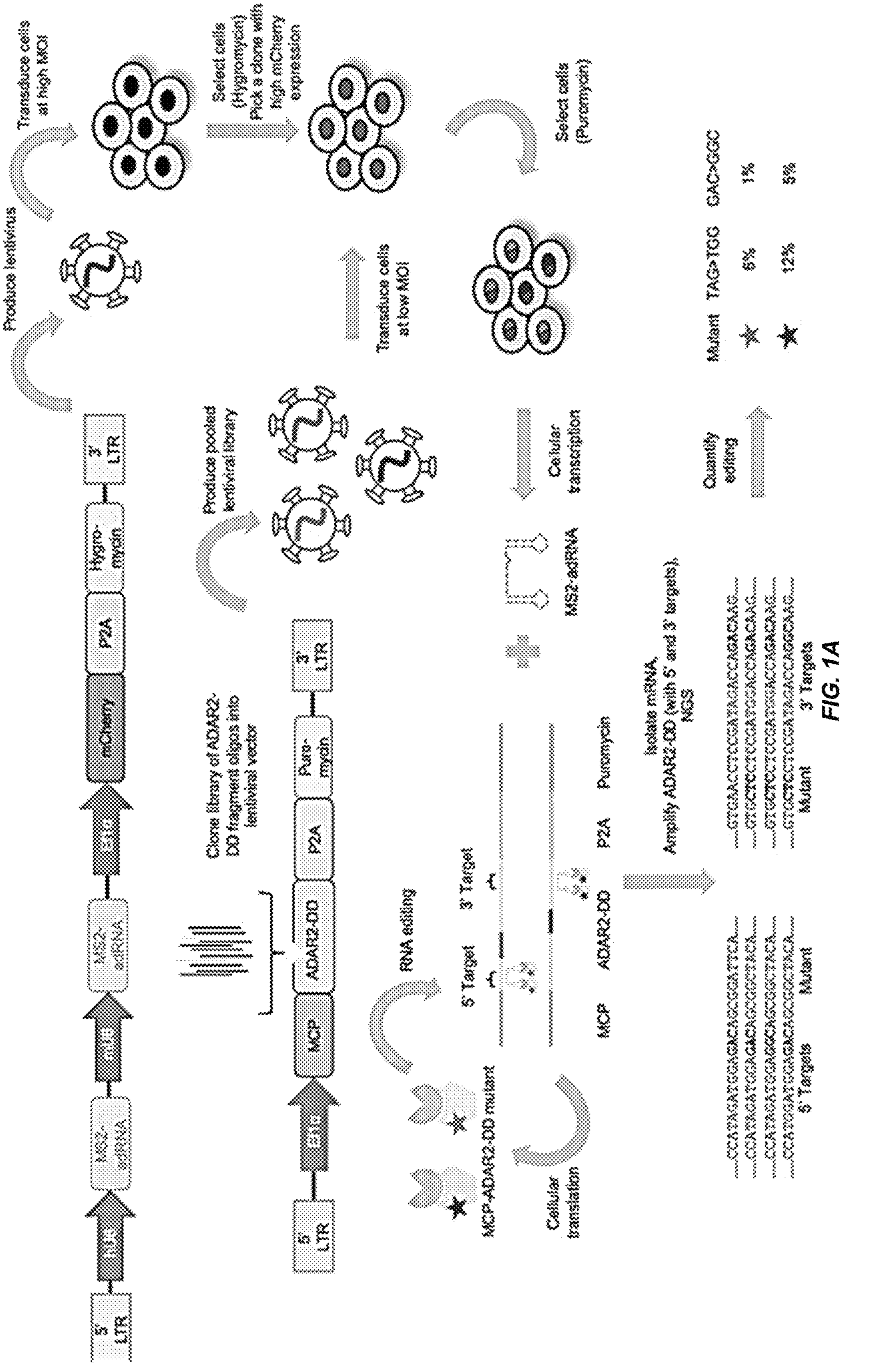
FIG. 1A-B shows (A) Schematic of the deep mutational scanning approach. HEK293FT cells were transduced with the MS2-adRNA lentiviruses at a high MOI and a single clone was selected based on mCherry expression. These cells bearing the MS2-adRNA were then transduced with the lentiviral library of MCP-ADAR2-DD-NES variants at a low MOI to ensure delivery of a single variant per cell. Upon translation in the cell, each MCP-ADAR2-DD variant, in combination with the MS2-adRNA, edited its own transcript creating a synonymous change. These transcripts were then sequenced to quantify the editing efficiency associated with each variant. (SEQ ID NOs: 99-106, in order of appearance). (B) Heatmaps illustrating impact of single amino acid substitutions in residues 340-600 on the ability of the ADAR2-DD to edit a UAG motif. Rectangles are colored according to the scale bar on the right depicting the Z-score for editing a UAG motif as compared to the ADAR2-DD. Diagonal bars indicate standard error. The amino acids in the wild-type ADAR2-DD are indicated in the heatmap with a •. Amino acids are indicated on the left and grouped based on type of amino acid: positively charged, negatively charged, polar-neutral, non-polar, aromatic and unique. The heatmap bars at the top represent amino acid conservation score and surface exposure respectively. were then transduced with the lentiviral library of MCP-ADAR2-DD-NES variants at a low MOI to ensure delivery of a single variant per cell. Upon translation in the cell, each MCP-ADAR2-DD variant, in combination with the MS2-adRNA, edited its own transcript creating a synonymous change. These transcripts were then sequenced to quantify the editing efficiency associated with each variant. (B) Heatmaps illustrating impact of single amino acid substitutions in residues 340-600 on the ability of the ADAR2-DD to edit a UAG motif. Rectangles are colored according to the scale bar on the right depicting the Z-score for editing a UAG motif as compared to the ADAR2-DD. Diagonal bars indicate standard error. The amino acids in the wild-type ADAR2-DD are indicated in the heatmap with a •. Amino acids are indicated on the left and grouped based on type of amino acid: positively charged, negatively charged, polar-neutral, non-polar, aromatic and unique. The heatmap bars at the top represent amino acid conservation score and surface exposure respectively.

FIG. 5A-D shows (A) Schematic of the ADAR2-DD showing oligonucleotide pools used to create the DMS library along with editing sites and primer binding sites. Oligonucleotide libraries 1, 2 and 3 were assayed for editing at the sites located at the 5' end while libraries 4, 5 and 6 were assayed for editing at the 3' end. Libraries 1 and 2 were amplified using primers 5' seq F and 5' seq R2, library 3 with 5' seq F and 5' seq R, library 4 with 3' seq F and 3' seq R and libraries 5 and 6 with 3' seq F2 and 3' seq R. (B) Library coverage of the ADAR2-DD DMS plasmids. (C) Histogram of variant counts from the DMS. 4958 of the 4959 variants were detected. (D) Replicate correlation for the ADAR2-DD DMS. The X and Y axes on every plot represent the fraction of edited reads.

Figure 6:
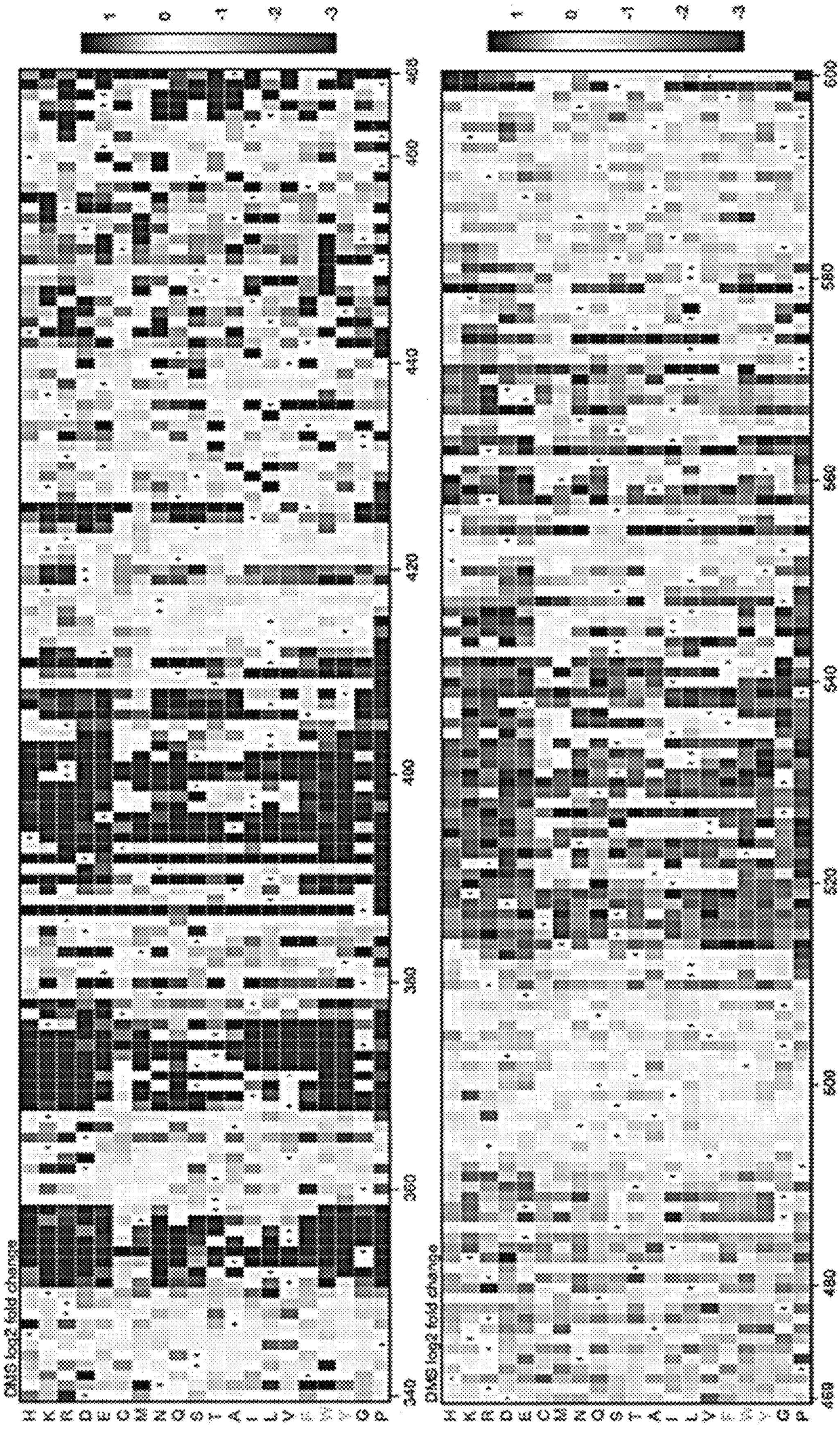

FIG. 6 shows heatmaps illustrating how single amino acid substitutions in residues 340-600 impact the ability of the ADAR2-DD to edit a UAG motif. Rectangles are colored according to the scale bar on the bottom right depicting the geometric mean of log 2 fold change in editing efficiency as compared to the ADAR2-DD. The amino acids in the wild-type ADAR2-DD are indicated in the heatmap with a •. Amino acids are indicated on the left and grouped based on type of amino acid: positively charged, negatively charged, polar-neutral, non-polar, aromatic and unique.

Figure 2A:
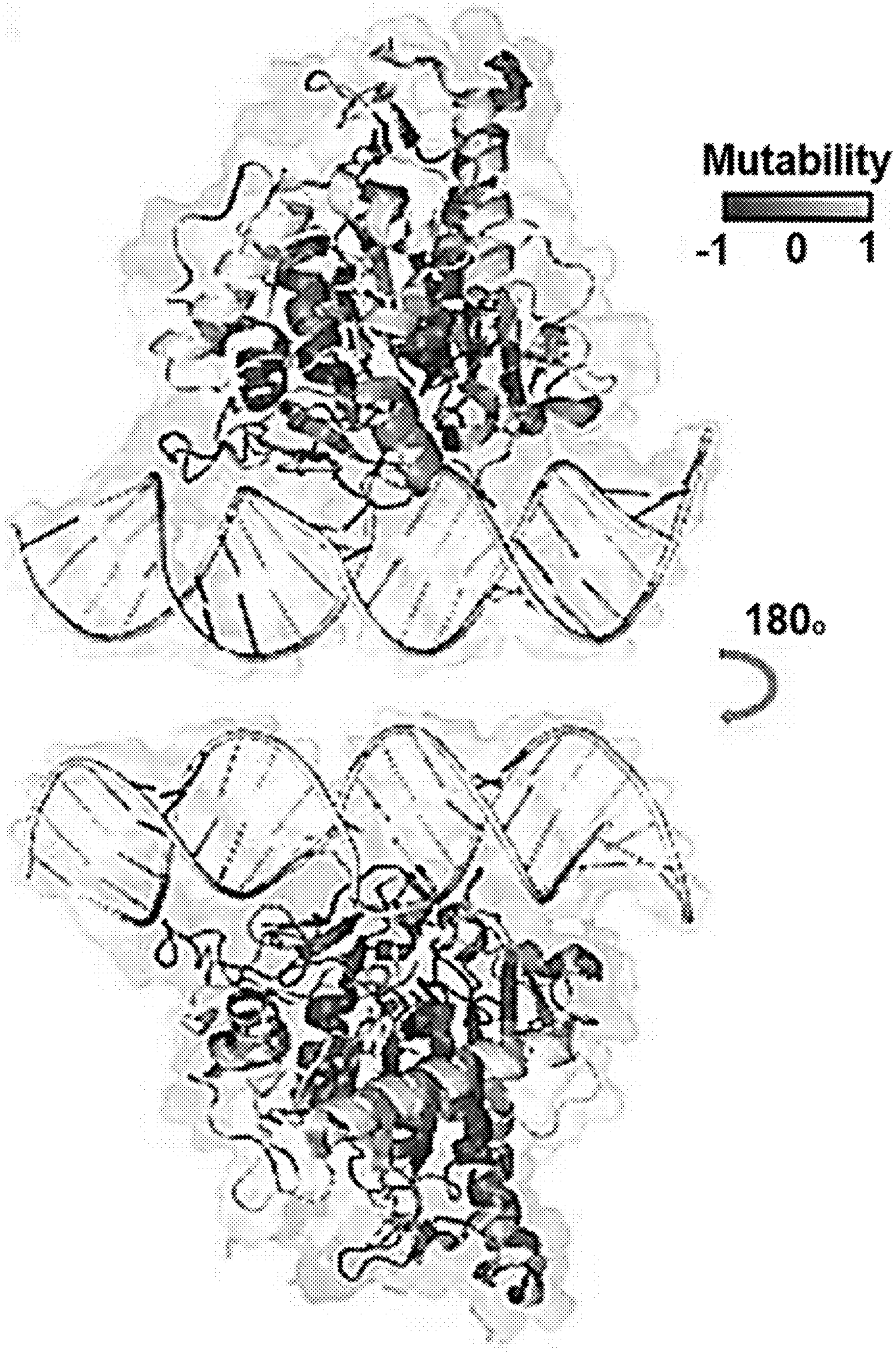
FIG. 2A-E shows (A) Structure of the ADAR2-DD bound to its substrate (PDB 5HP3) with the degree of mutability of each residue as measured by the DMS highlighted. Residues that are highly intolerant to mutations are colored red while residues that are highly mutable are colored yellow. Residues not assayed in this DMS are colored white. (B) List of mutants from the pooled DMS screens were individually validated in an arrayed luciferase assay using a cluc reporter bearing a UAG stop codon. The plots represent fold change as compared to the wild-type ADAR2 for (i) the arrayed luciferase assay and (ii) the DMS screen. Values represent mean+/−SEM for the luciferase assay (n>2) and mean for the DMS (n=2). (C) Using the library chassis of the DMS, a screen of deaminase domain mutants (in an E488Q background) was performed to mine variants with improved activity against 5'-GA-3' RNA motifs. (D) Structure of the ADAR2-DD(E488Q) bound to its substrate (PDB 5ED1) with the N496 residue highlighted in red, the E488Q residue in cyan, the target adenosine in green, the orphaned cytosine in magenta and the adenosine on the unedited strand that base pairs with the 5' uracil flanking the target adenosine in orange. (E) (i) The N496F, E488Q mutant was validated in a luciferase assay using a cluc reporter bearing a UGA stop codon. The plot represents fold change as compared to the ADAR2-DD(E488Q). Values represent mean+/−SEM (n=6). (ii) Editing of a GAC motif in the 3'UTR of the RAB7A transcript, and (iii) a GAG motif in the CDS of the KRAS transcript. Values represent mean+/−SEM (n=3). P-values were computed using a two-tailed unpaired t-test. All experiments were carried out in HEK293FT cells.
Figure 2B:
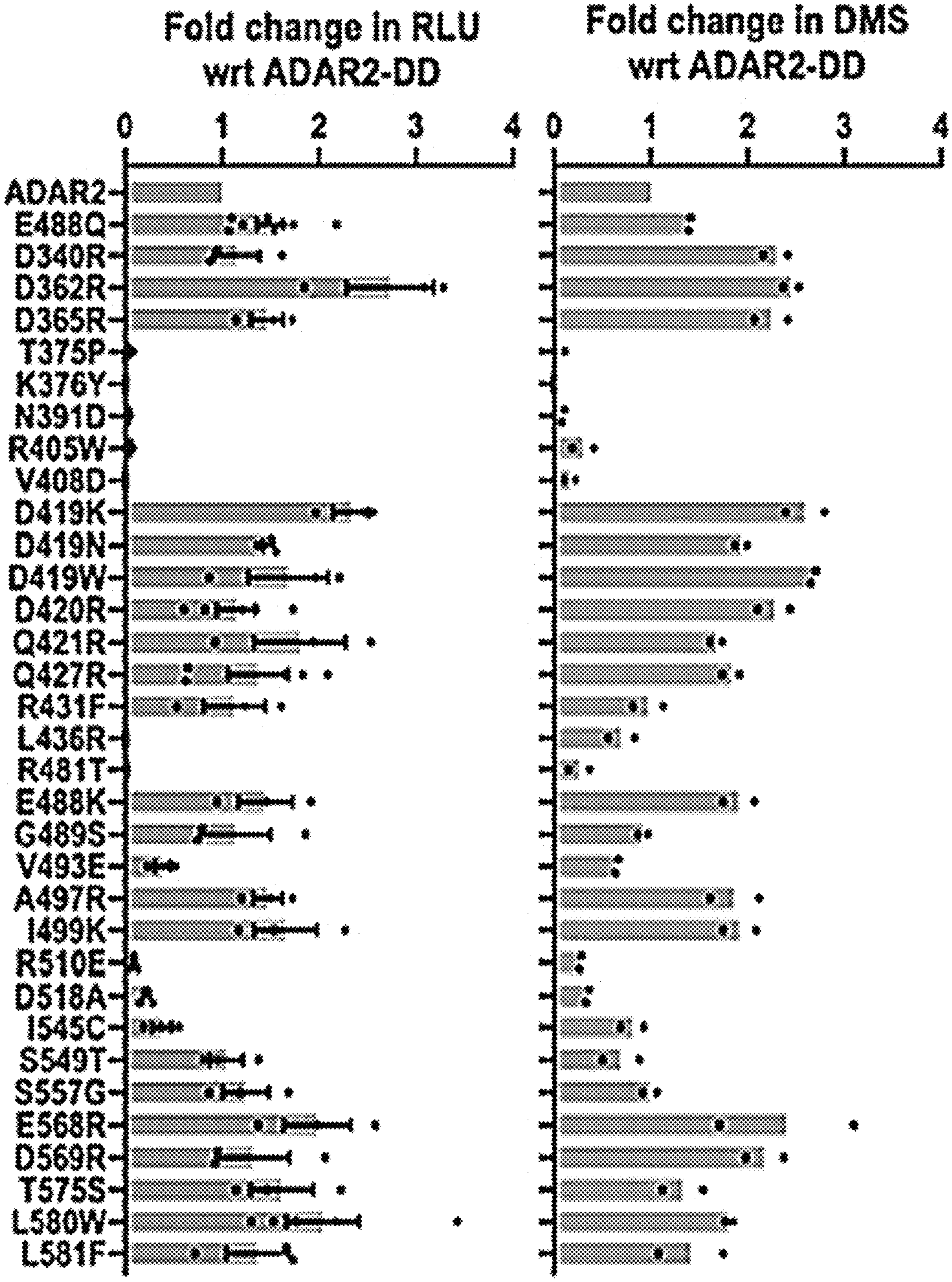
Figure 2C:
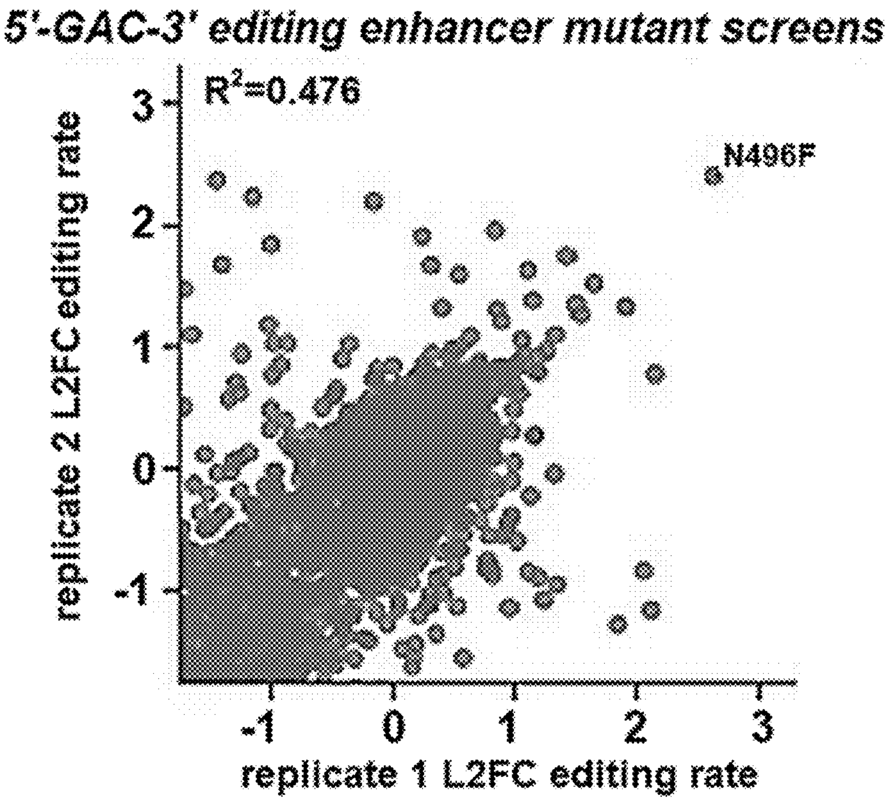
Figure 2D:
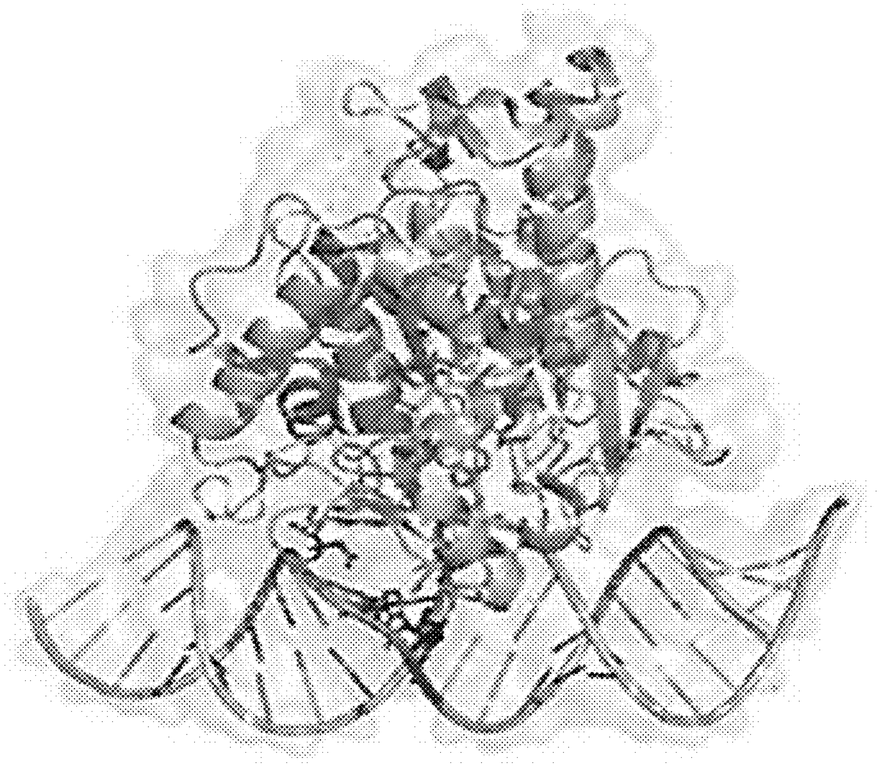
Figure 2E:
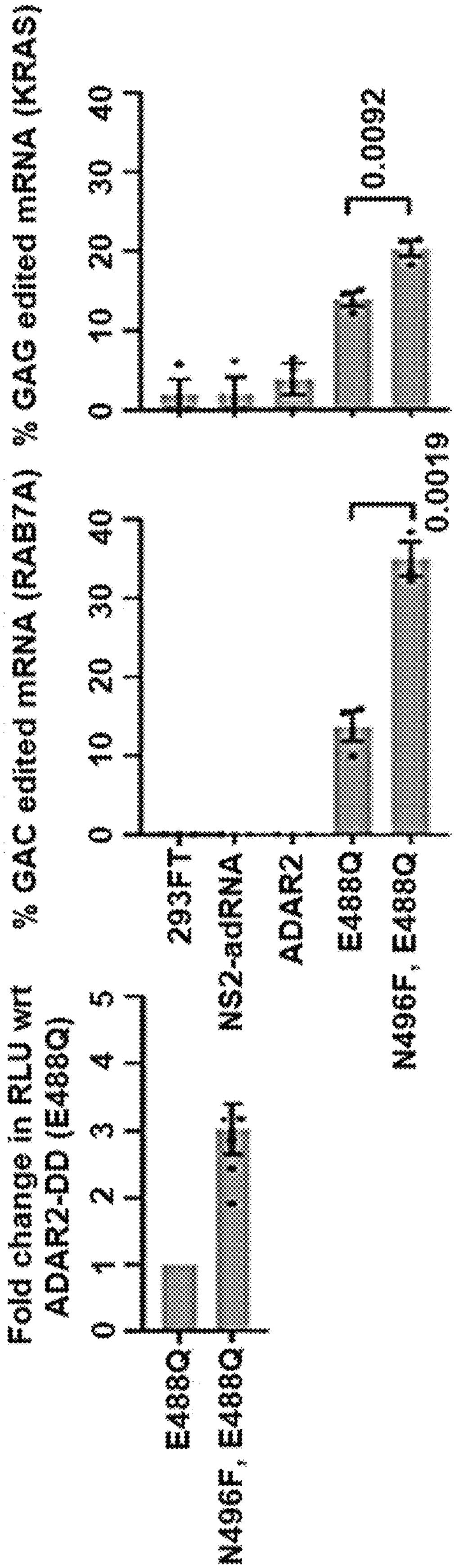
Figure 7:
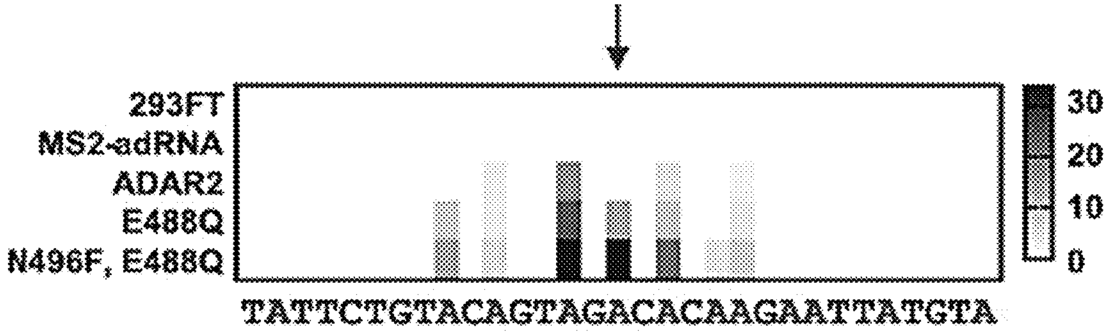

FIG. 7 shows a heatmap depicting hyper-editing observed with the N496F, E488Q double mutant corresponding to the RAB7A plot in FIG. 2*e*. The red arrow indicates the target. (SEQ ID NO:107).

Figure 8A:
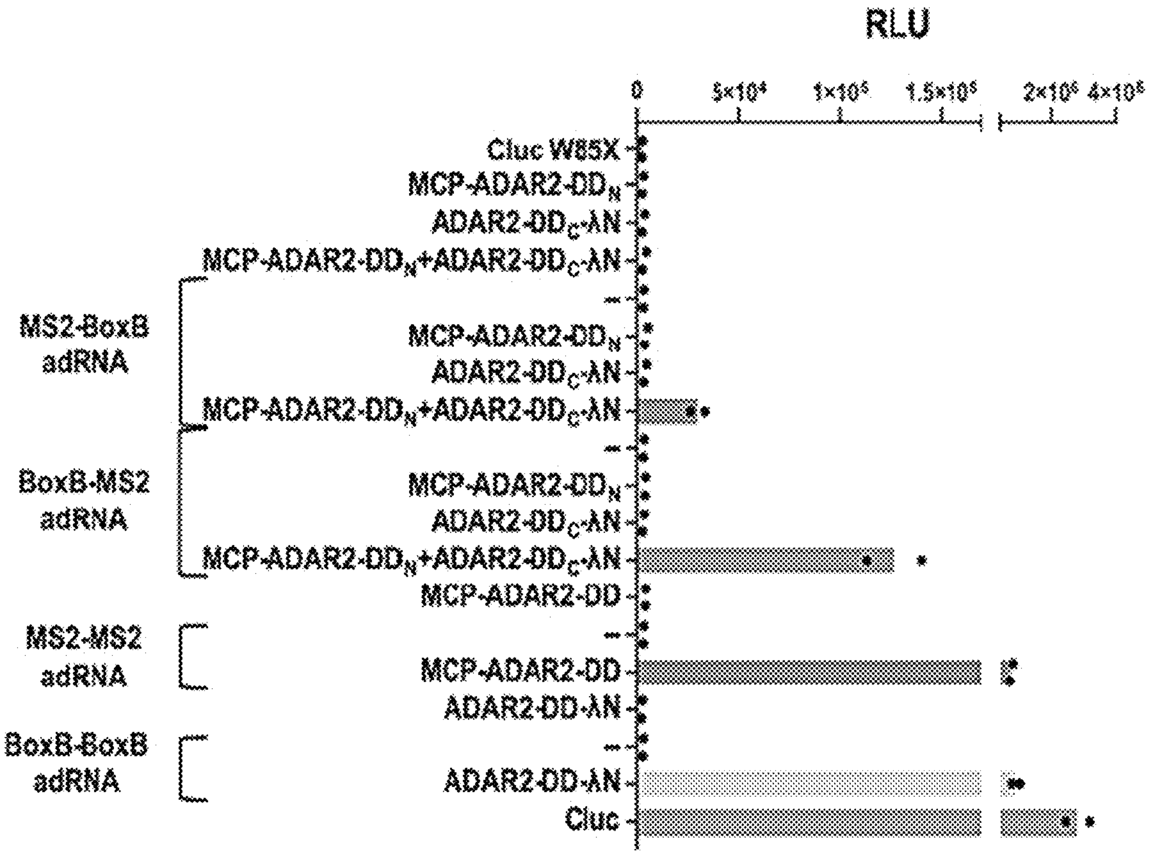
Figure 8B:
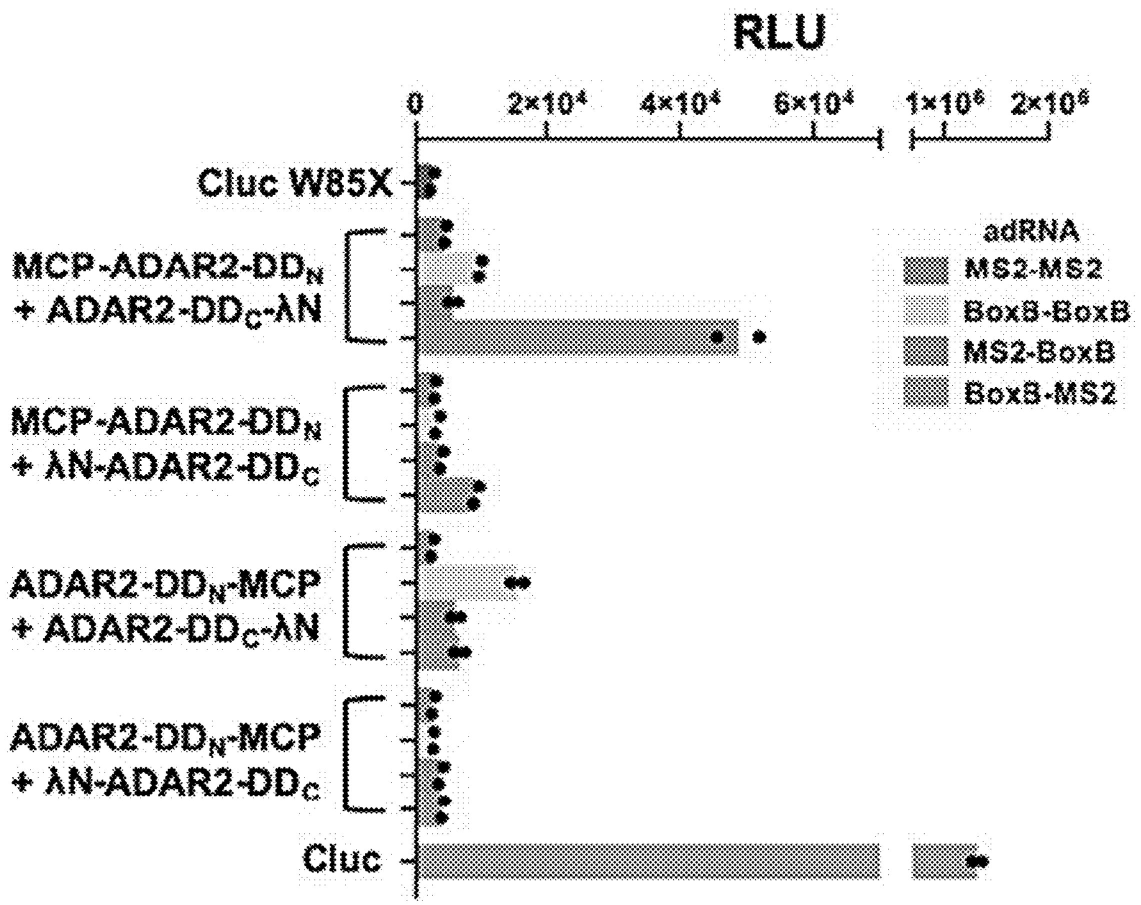

FIG. 8A-B shows (A) All components of the split-ADAR2 system were tested for their ability to edit RNA via the luciferase assay. Restoration of luciferase activity is observed only when every component is delivered. Values represent mean (n=2). (B) The importance of orientation of the N- and C-terminal fragments in forming a functional ADAR2-DD is assayed via the luciferase assay. Chimeric and non-chimeric adRNA are used to recruit the split-ADAR2 pairs. Values represent mean (n=2).

Figure 4A:
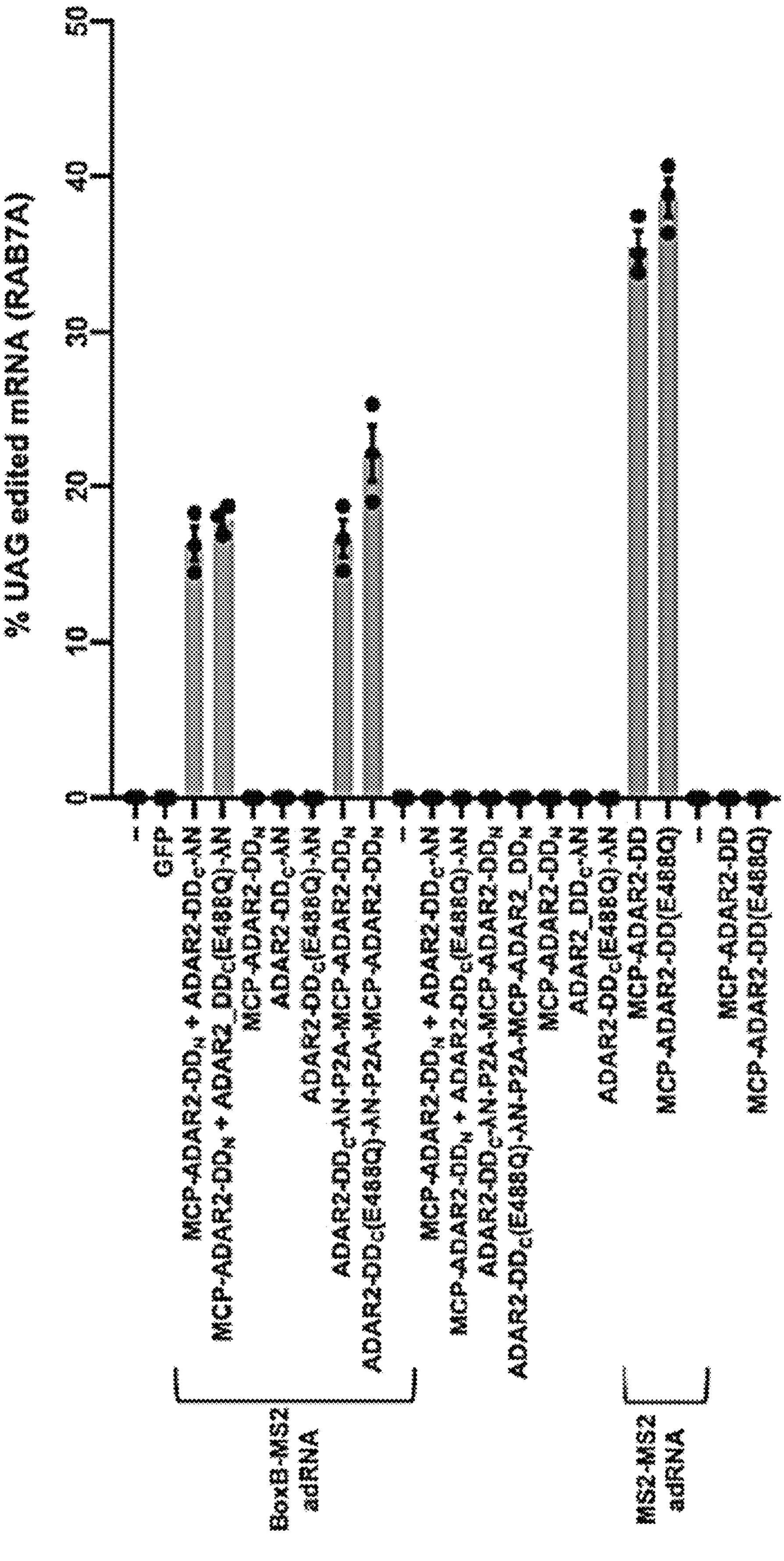
FIG. 4A-D shows (A) The components of the split-ADAR2 system based on pair 12 were tested for their ability to edit the RAB7A transcript. Editing was observed only when every component was delivered. Values represent mean+/−SEM (n=3). (B) 2D histograms comparing the transcriptome-wide A-to-G editing yields observed with each construct (y-axis) to the yields observed with the control sample (x-axis). Each histogram represents the same set of reference sites, where read coverage was at least 10 and at least one putative editing event was detected in at least one sample. Bins highlighted in red contain sites with significant changes in A-to-G editing yields when comparing treatment to control sample. Red crosses in each plot indicate the 100 sites with the smallest adjusted P values. Blue circles indicate the intended target A site within the RAB7A transcript. All experiments were carried out in HEK293FT cells. (C) The split-ADAR2 system was assayed for editing the KRAS and CKB transcripts. Values represent mean+/−SEM (n=3). (D) A split-RESCUE was engineered based on pair 12 and assayed for C-to-U editing of the RAB7A transcript. Values represent mean+/−SEM (n=3).
Figure 4B:
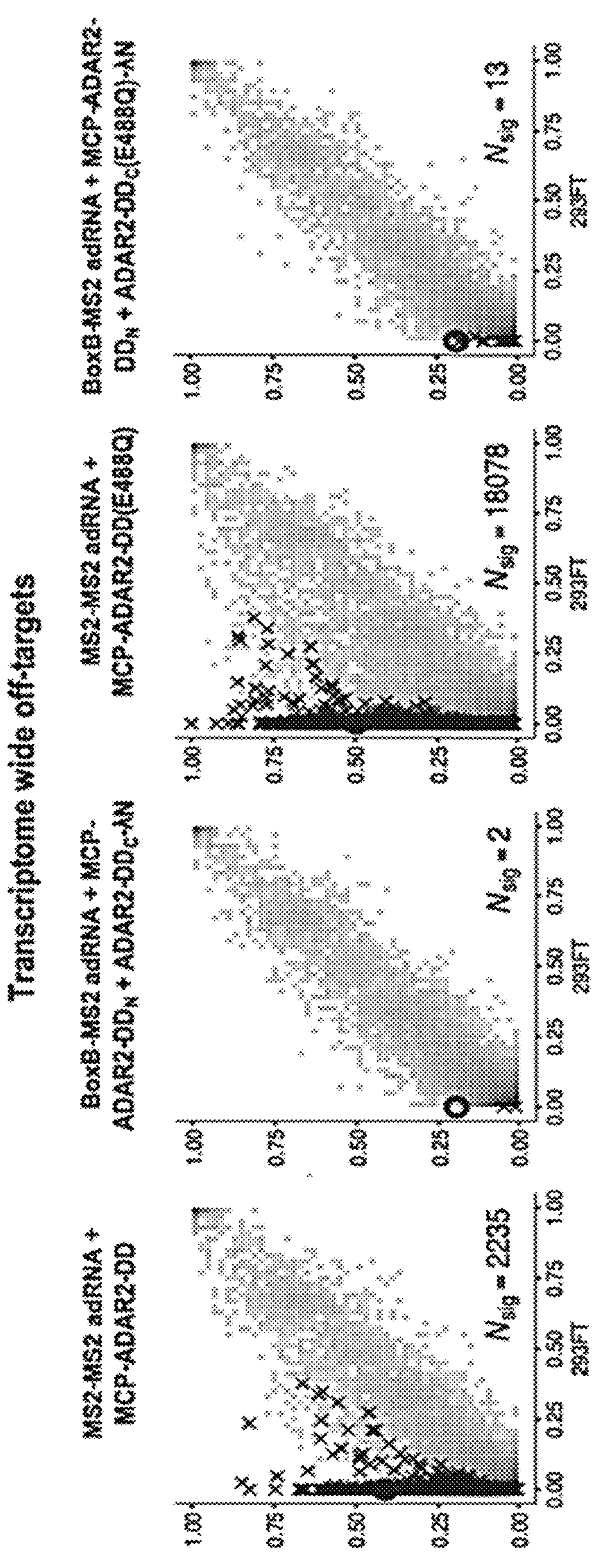
Figure 9A:
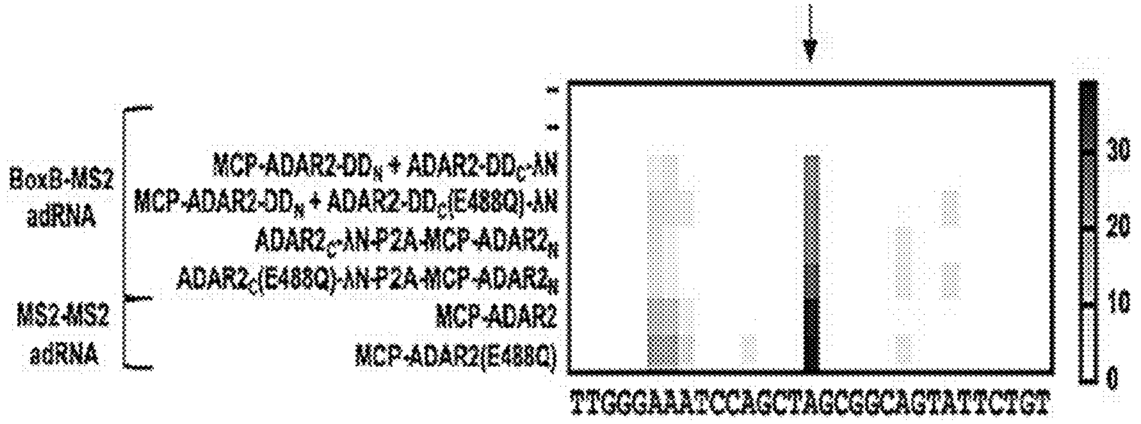
Figure 9B:
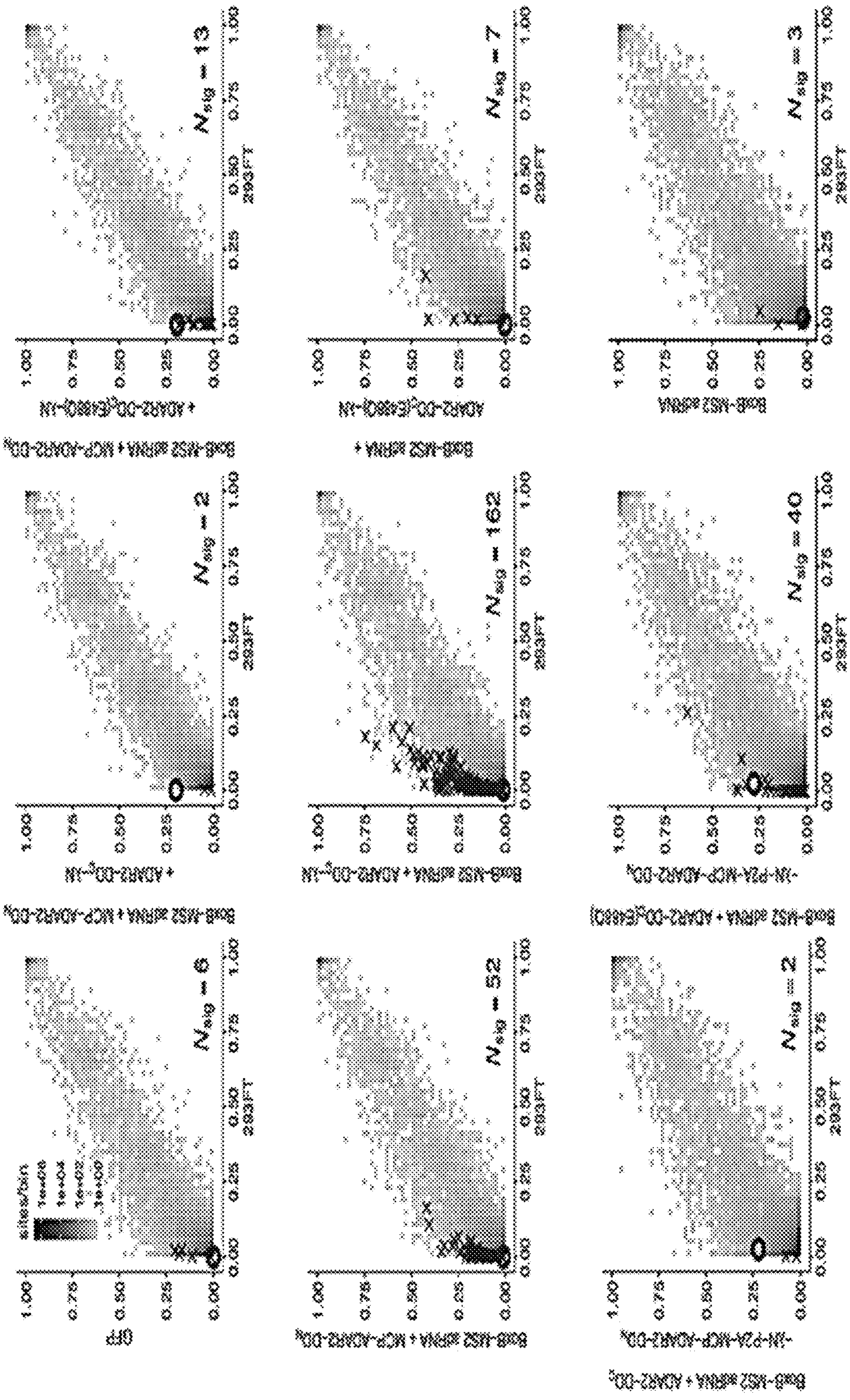

FIG. 9A-B shows (A) Heatmap depicting hyper-editing observed with the split-ADAR2 system corresponding to the plot in FIG. 4*a*. The red arrow indicates the target adenosine. (SEQ ID NO:108). (B) 2D histograms comparing the transcriptome-wide A-to-G editing yields observed with each construct from FIG. 4*a* (y-axis) to the yields observed with the control sample (x-axis). Each histogram represents the same set of 22583 reference sites, where read coverage was at least 10 and at least one putative editing event was detected in at least one sample. Bins highlighted in red contain sites with significant changes in A-to-G editing yields when comparing treatment to control sample. Red crosses in each plot indicate the 100 sites with the smallest adjusted p-values. Blue circles indicate the intended target A-site within the RAB7A transcript. Large counts in bins near the lower-left corner likely correspond not only to low editing yields in both test and control samples, but also to sequencing errors and alignment errors. Large counts in bins near the upper-right corner of each plot likely correspond to homozygous single nucleotide polymorphisms (SNPs), as well as other differences between the reference genome and the genome of the HEK293FT cell line used in the experiments.

Figure 10:
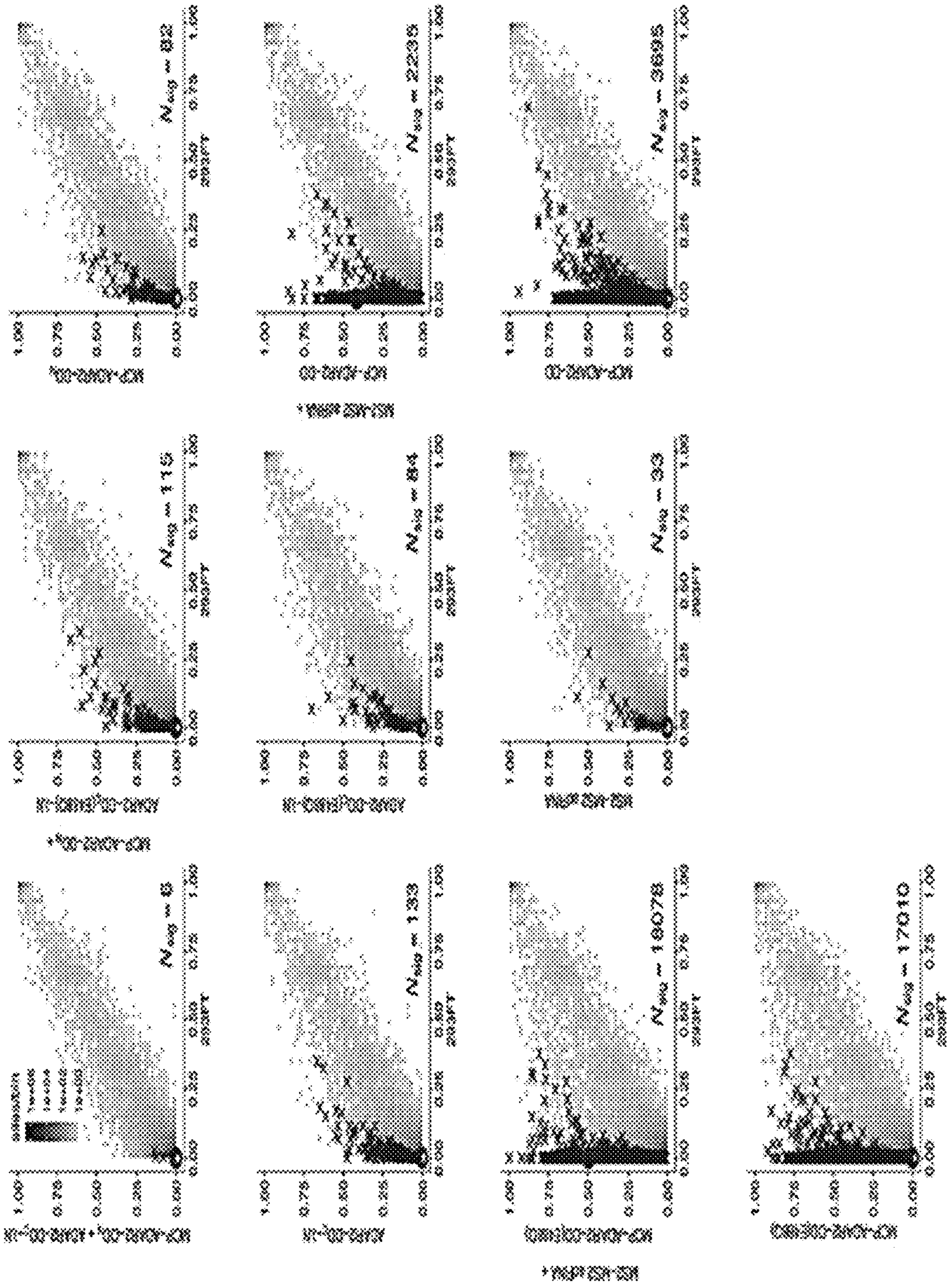
Figure 11:
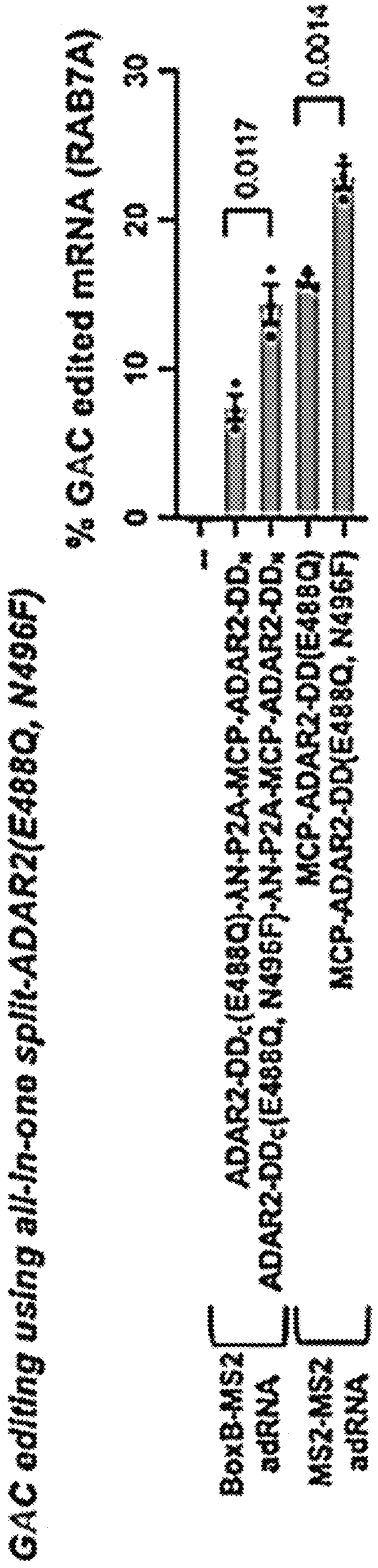
Figure 11B:
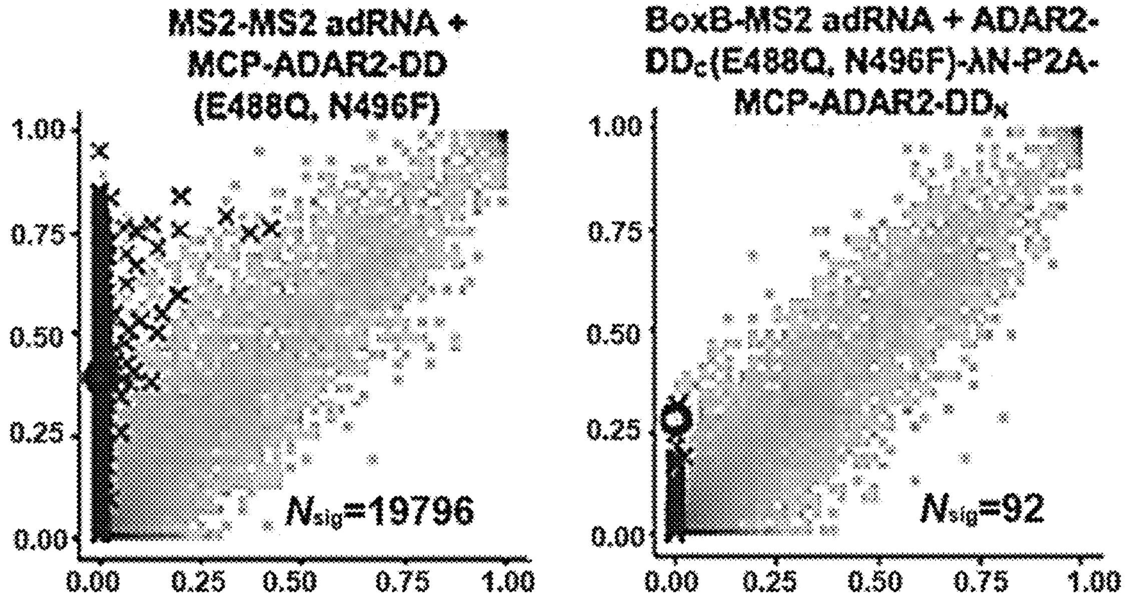
Figure 11C:
Figure 11D:
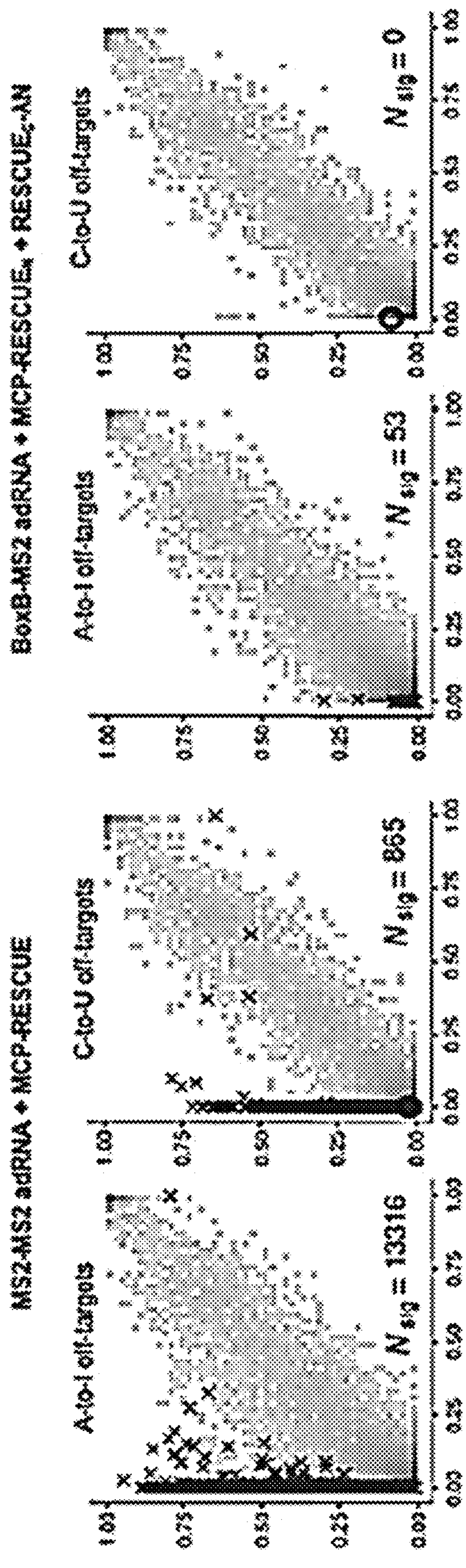

FIG. 10 shows 2D histograms comparing the transcriptome-wide A-to-G editing yields observed with each split-ADAR2 construct (y-axis) to the yields observed with the control sample (x-axis).

FIG. 11A-D shows (A) The split-ADAR2(E488Q, N496F) system was assayed for editing a GAC site in the RAB7A transcript. Values represent mean+/−SEM (n=3). (B) 2D histograms comparing the transcriptome-wide A-to-G editing yields observed with the full-length and split ADAR2(E488Q, N496F) constructs (y-axis) to the yields observed with the control sample (x-axis). (C) A split-RESCUE was engineered and assayed for C-to-U editing of the RAB7A transcript. Values represent mean+/−SEM (n=3). (D) 2D histograms comparing the transcriptome-wide A-to-G and C-to-U editing yields observed with the full-length and split RESCUE constructs (y-axis) to the yields observed with the control sample (x-axis). All experiments were carried out in HEK293FT cells.

Figure 12A:
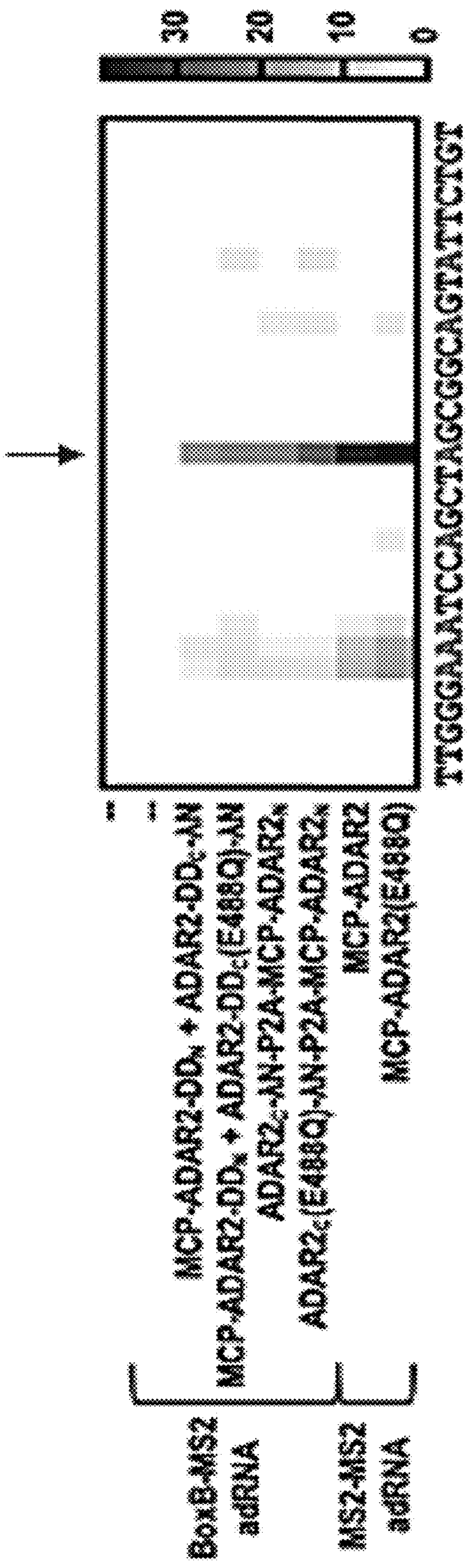
Figure 12B:
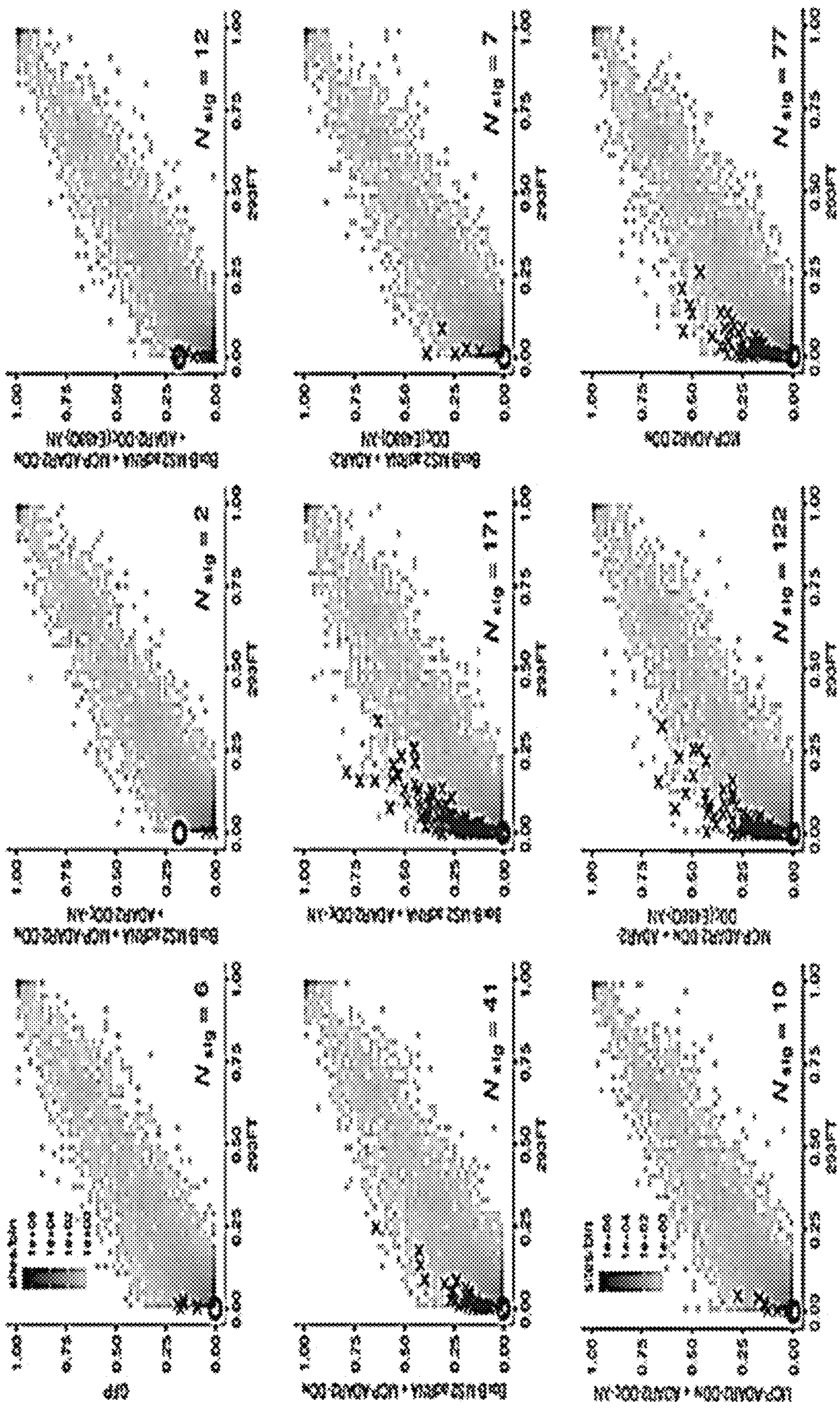

FIG. 12A-B shows (A) Heatmap depicting hyper-editing observed with the split-ADAR2 system corresponding to the plot in FIG. 4*a*. The red arrow indicates the target adenosine. (SEQ ID NO:108). (B) 2D histograms comparing the transcriptome-wide A-to-G editing yields observed with each construct from FIG. 4*a* (y-axis) to the yields observed with the control sample (x-axis). Each histogram represents the same set of 25753 reference sites, where read coverage was at least 10 and at least one putative editing event was detected in at least one sample. Bins highlighted in red contain sites with significant changes in A-to-G editing yields when comparing treatment to control sample. Crosses in each plot indicate the 100 sites with the smallest adjusted p-values. Circles indicate the intended target A-site within the RAB7A transcript. Large counts in bins near the lower-left corner likely correspond not only to low editing yields in both test and control samples, but also to sequencing errors and alignment errors. Large counts in bins near the upper-right corner of each plot likely correspond to homozygous single nucleotide polymorphisms (SNPs), as well as other differences between the reference genome and the genome of the HEK293FT cell line used in the experiments.

Figure 13:
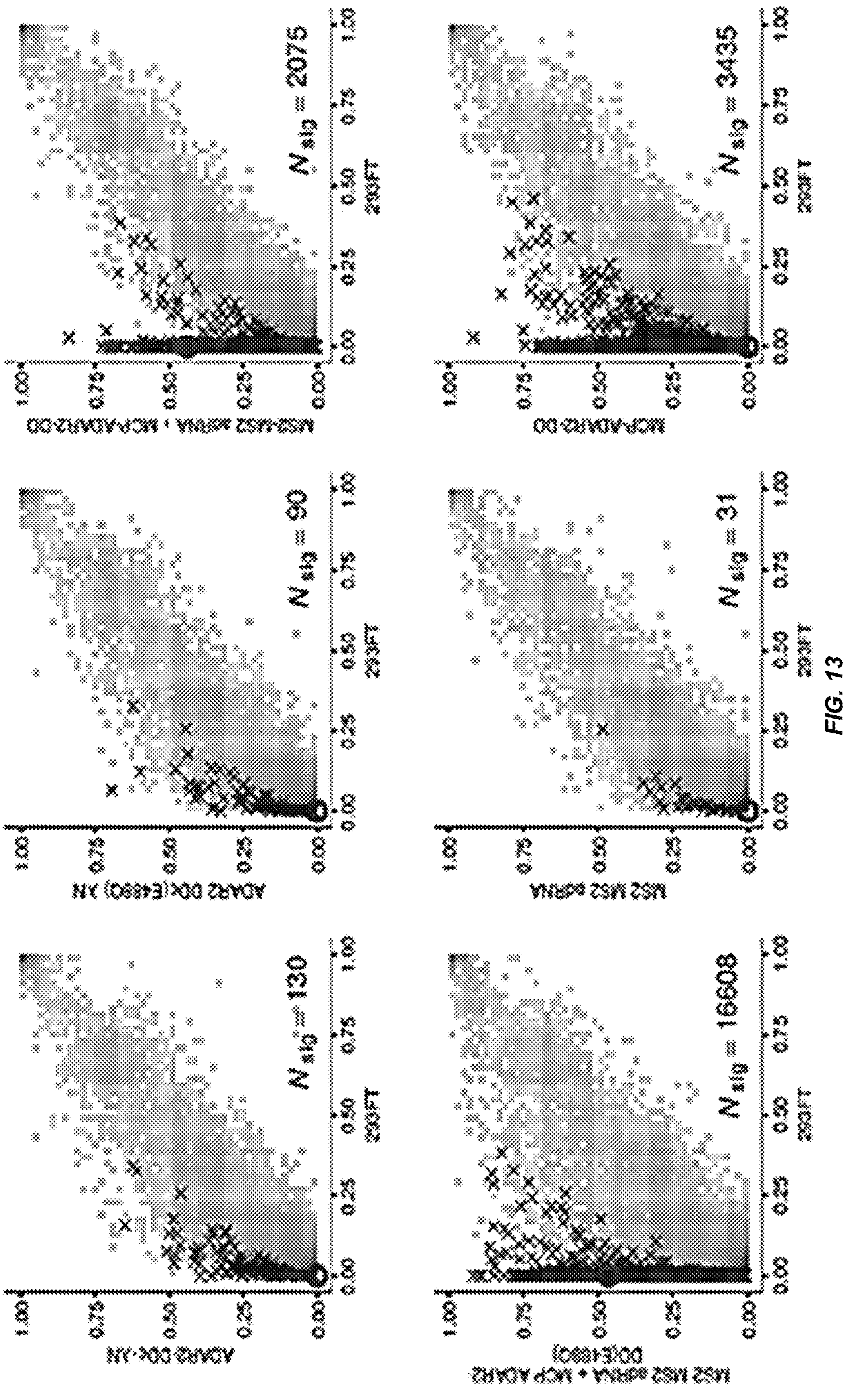
Figure 13:
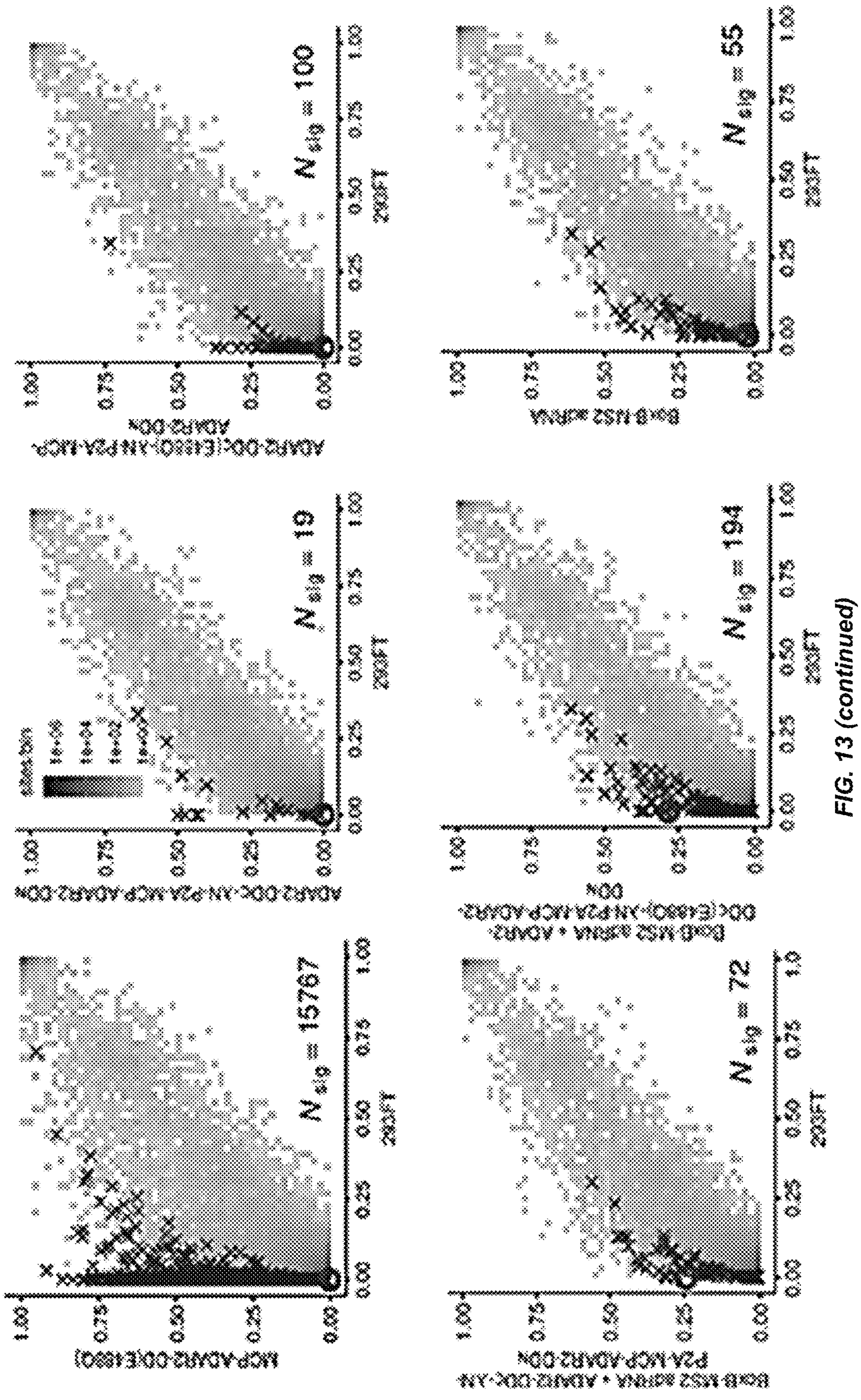

FIG. 13 shows 2D histograms comparing the transcriptome-wide A-to-G editing yields observed with each split-ADAR2 construct (y-axis) to the yields observed with the control sample (x-axis). Blue circles indicate the intended target A-site within the RAB7A transcript.

Figure 14:
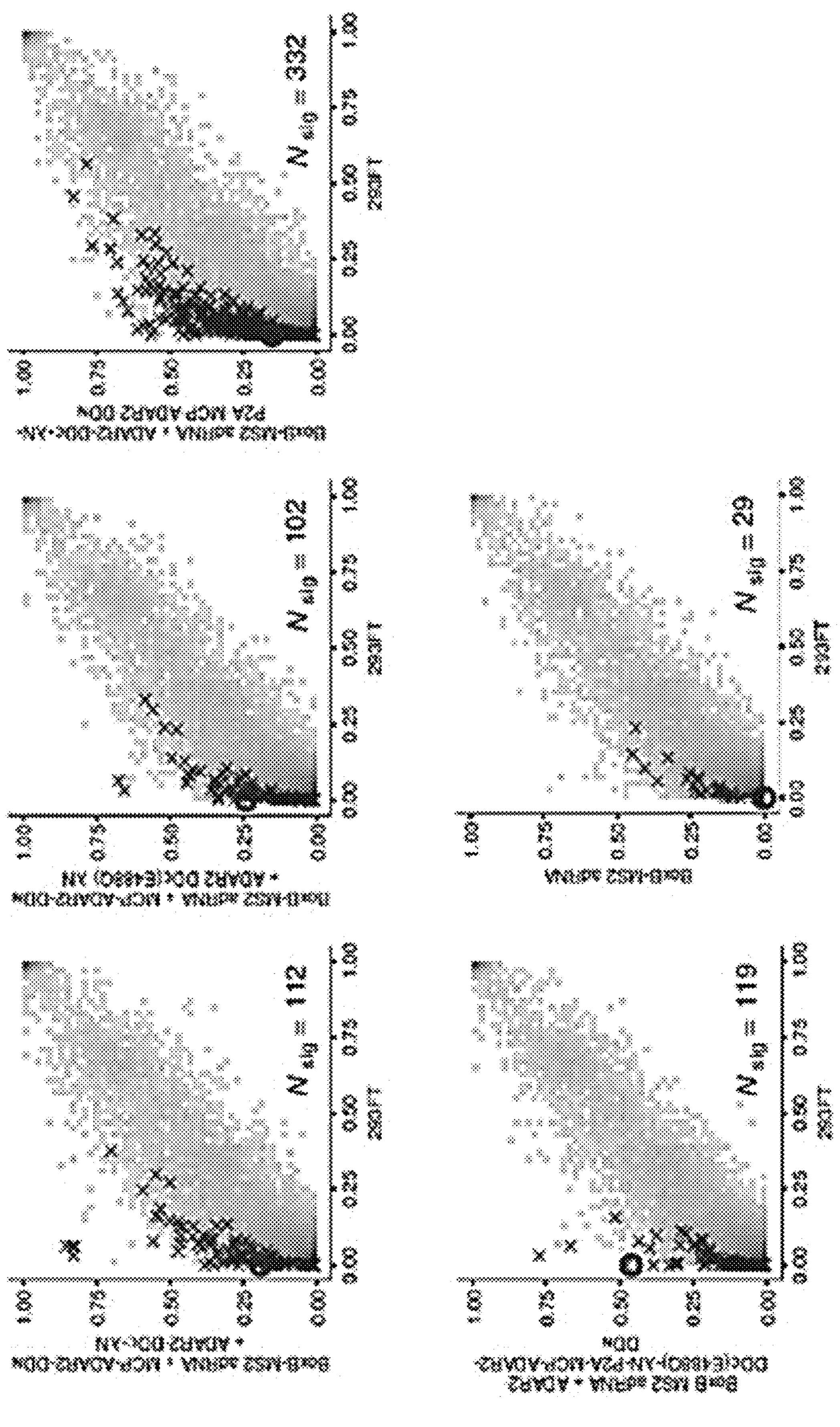

FIG. 14 shows 2D histograms comparing the transcriptome-wide A-to-G editing yields observed with each split-ADAR2 construct (y-axis) to the yields observed with the control sample (x-axis). Blue circles indicate the intended target A-site within the KRAS transcript.

Figure 15:
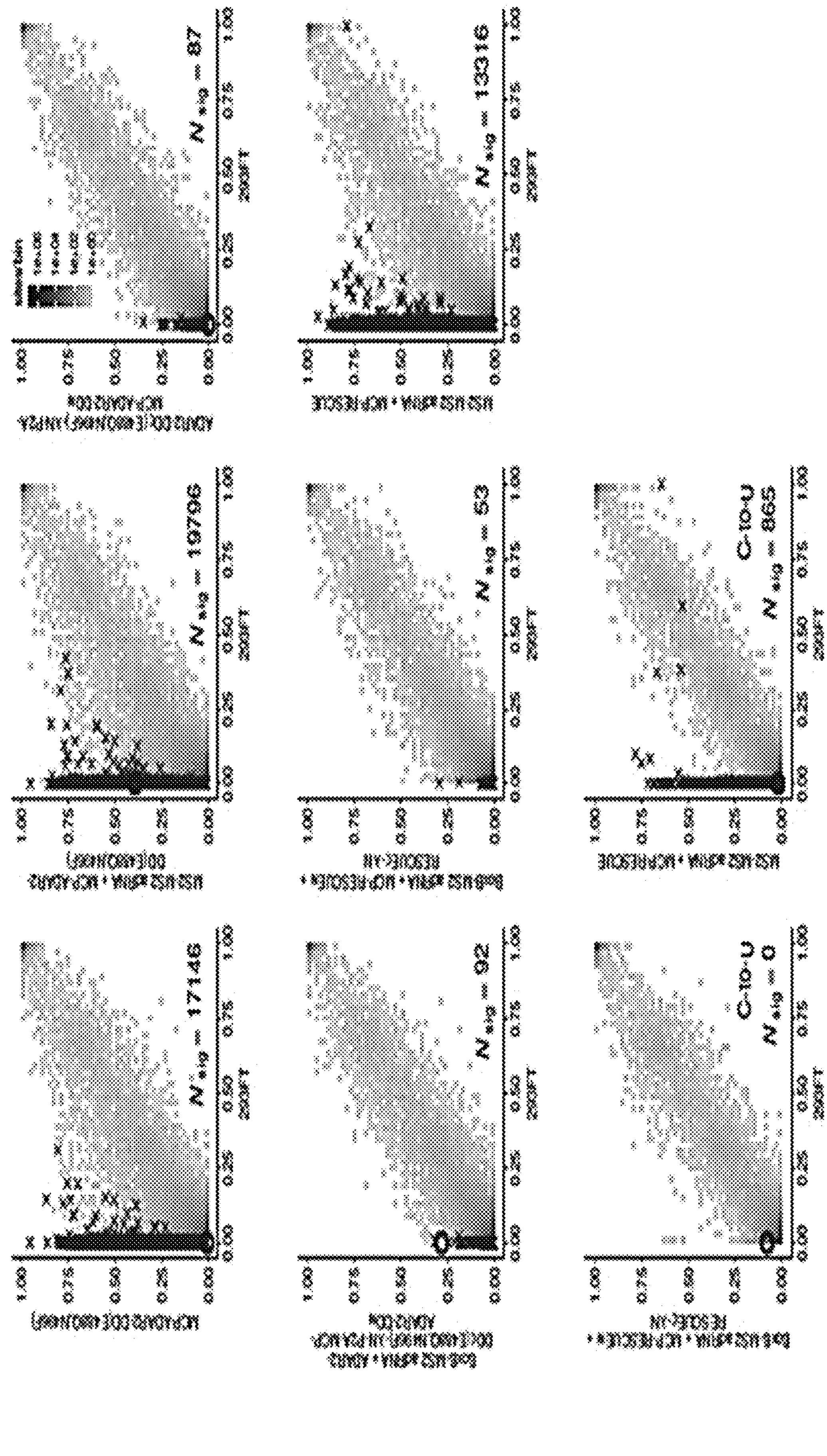

FIG. 15 shows 2D histograms comparing the transcriptome-wide A-to-G editing yields observed with split-ADAR2 (E488Q, N496F) or split-RESCUE (y-axis) to the yields observed with the control sample (x-axis). Blue circles indicate the intended target A-site within the RAB7A transcript. Additionally, C-to-U editing yields observed with split-RESCUE were also quantified.

DETAILED DESCRIPTION

Unless defined otherwise, all technical and scientific terms used herein have the same meanings as commonly understood by one of ordinary skill in the art to which this disclosure belongs. All nucleotide sequences provided herein are presented in the 5' to 3' direction unless identified otherwise. Although any methods and materials similar or equivalent to those described herein can be used in the practice or testing of the disclosure, the preferred methods, devices, and materials are now described. All technical and patent publications cited herein are incorporated herein by reference in their entirety. Nothing herein is to be construed as an admission that the disclosure is not entitled to antedate such disclosures.

The practice of the technology will employ, unless otherwise indicated, some conventional techniques of tissue culture, immunology, molecular biology, microbiology, cell biology, and recombinant DNA. See, e.g., Green and Sambrook eds. (2012) Molecular Cloning: A Laboratory Manual, 4th edition; the series Ausubel et al. eds. (2015) Current Protocols in Molecular Biology; the series Methods in Enzymology (Academic Press, Inc., N.Y.); MacPherson et al. (2015) PCR 1: A Practical Approach (IRL Press at Oxford University Press); MacPherson et al. (1995) PCR 2: A Practical Approach; McPherson et al. (2006) PCR: The Basics (Garland Science); Harlow and Lane eds. (1999) Antibodies, A Laboratory Manual; Greenfield ed. (2014) Antibodies, A Laboratory Manual; Freshney (2010) Culture of Animal Cells: A Manual of Basic Technique, 6th edition; Gait ed. (1984) Oligonucleotide Synthesis; U.S. Pat. No. 4,683,195; Hames and Higgins eds. (1984) Nucleic Acid Hybridization; Anderson (1999) Nucleic Acid Hybridization; Herdewijn ed. (2005) Oligonucleotide Synthesis: Methods and Applications; Hames and Higgins eds. (1984) Transcription and Translation; Buzdin and Lukyanov ed. (2007) Nucleic Acids Hybridization: Modern Applications; Immobilized Cells and Enzymes (IRL Press (1986)); Grandi ed. (2007) In vitro Transcription and Translation Protocols, 2nd edition; Guisan ed. (2006) Immobilization of Enzymes and Cells; Perbal (1988) A Practical Guide to Molecular Cloning, 2nd edition; Miller and Calos eds, (1987) Gene Transfer Vectors for Mammalian Cells (Cold Spring Harbor Laboratory); Makrides ed. (2003) Gene Transfer and Expression in Mammalian Cells; Mayer and Walker eds. (1987) Immunochemical Methods in Cell and Molecular Biology (Academic Press, London); Lundblad and Macdonald eds. (2010) Handbook of Biochemistry and Molecular Biology, 4th edition; Herzenberg et al. eds (1996) Weir's Handbook of Experimental Immunology, 5th ed.; and/or more recent editions thereof.

The terminology used in the description herein is for the purpose of describing particular embodiments only and is not intended to be limiting of the disclosure.

All numerical designations, e.g., pH, temperature, time, concentration, and molecular weight, including ranges, are approximations which are varied (+) or (−) by increments of 1.0 or 0.1, as appropriate or alternatively by a variation of +/−15%, or alternatively 10% or alternatively 5% or alternatively 2%.

Unless the context indicates otherwise, it is specifically intended that the various features of the disclosure described herein can be used in any combination. Moreover, the disclosure also contemplates that in some embodiments, any feature or combination of features set forth herein can be excluded or omitted. To illustrate, if the specification states that a complex comprises components A, B and C, it is specifically intended that any of A, B or C, or a combination thereof, can be omitted and disclaimed singularly or in any combination.

Unless indicated otherwise, all specified embodiments, features, and terms intend to include both the recited embodiment, feature, or term and biological equivalents thereof.

As used in the specification and claims, the singular form "a", "an" and "the" include plural references unless the context dictates otherwise. For example, the term "a polypeptide" includes a plurality of polypeptides, including mixtures thereof.

The term "about," as used herein can mean within an acceptable error range for the particular value as determined by one of ordinary skill in the art, which can depend in part on how the value is measured or determined, e.g., the limitations of the measurement system. For example, "about" can mean plus or minus 10%, per the practice in the art. Alternatively, "about" can mean a range of plus or minus 20%, plus or minus 10%, plus or minus 5%, or plus or minus 1% of a given value. Alternatively, particularly with respect to biological systems or processes, the term can mean within an order of magnitude, within 5-fold, or within 2-fold, of a value. Where particular values are described in the application and claims, unless otherwise stated the term "about" meaning within an acceptable error range for the particular value can be assumed. Also, where ranges and/or subranges of values are provided, the ranges and/or subranges can include the endpoints of the ranges and/or subranges. In some cases, variations can include an amount or concentration of 20%, 10%, 5%, 1%, 0.5%, or even 0.1% of the specified amount. It is to be understood, although not always explicitly stated, that all numerical designations are preceded by the term "about". It also is to be understood, although not always explicitly stated, that the reagents described herein are merely exemplary and that equivalents of such are known in the art. When the term "about" is used with reference to an amino acid or nucleic acid position in polymeric sequence, the term is meant to include the specifically recited residue and 1-2, 2-5, 5-10 or 10-20 residues or nucleotide on either end of the specifically recited position.

For the recitation of numeric ranges herein, each intervening number there between with the same degree of precision is explicitly contemplated. For example, for the range of 6-9, the numbers 7 and 8 are contemplated in addition to 6 and 9, and for the range 6.0-7.0, the number 6.0, 6.1, 6.2, 6.3, 6.4, 6.5, 6.6, 6.7, 6.8, 6.9, and 7.0 are explicitly contemplated.

The term "adapter pair," "tethering pair," "anchor moiety," and "tether moiety" refers to binding pairs (cognate pairs) that serve as handles or adapters on a molecule such that when an adapter pair is colocalized they bind/interact with one another thereby bringing any molecule linked/tethered to each adapter of the pair into proximity. For example, an adapter pair can be selected from the group consisting of: MS2 coat protein (SEQ ID NO:12) and SEQ ID NO:13 or 14; one or more LambdaN proteins (SEQ ID NO:16, 18, 20, or 22) and nutL-BoxB (SEQ ID NO:23) and nutR BoxB (SEQ ID NO:24); and PP7 coat protein and SEQ ID NO:25. Another pair is the tet/TAR pair, wherein the tet peptide is 15-17 amino acids sequence (SEQ ID NO:27) from the BIV Tat protein that binds the TAR element (SEQ ID NO:28). Other adapter pairs can be utilized (see, e.g., Bos et al., Adv. Exp. Med. Biol. 907:61-88, 2016, which is incorporated herein by reference). Programmable PUF domains can also be programmed such that their protein sequence can be designed to bind to a selected RNA sequence (see, e.g., Zhou et al., Nature Communication, 12:5107, 2021, the disclosure of which is incorporated herein by reference). Exemplary tethering systems include: MS2, PP7, Qβ, F2, GA, fr, JP501, M12, R17, BZ13, JP34, JP500, KU1, M11, MX1, TW18, VK, SP, FI, ID2, NL95, TW19, AP205, φCb5, φCb8r, φCb12r, φCb23r, 7s and PRR1.

In another embodiment, a tethering system can use a Cas (e.g., dCas13b) domain linked to a first portion of a catalytic domain of the disclosure and a second tethering moiety (e.g., MS2, PP7, Qβ, F2, GA, fr, JP501, M12, R17, BZ13, JP34, JP500, KU1, M11, MX1, TW18, VK, SP, FI, ID2, NL95, TW19, AP205, φCb5, φCb8r, φCb12r, φCb23r, 7s or PRR1), linked to a second domain of a catalytic domain of a split ADAR system of the disclosure. In this embodiment, the guide RNA molecules will include a RNA loop (CRISPR) recognized by the Cas (e.g., dCas13b) domain and a second RNA domain recognized by the second tethering moiety.

The terms "adenine", "guanine", "cytosine", "thymine", "uracil" and "hypoxanthine" (the nucleobase in inosine) as used herein refer to the nucleobases as such.

The terms "adenosine", "guanosine", "cytidine", "thymidine", "uridine" and "inosine", refer to the nucleobases linked to the (deoxy)ribosyl sugar.

The term "adeno-associated virus" or "AAV" as used herein refers to a member of the class of viruses associated with this name and belonging to the genus dependoparvovirus, family Parvoviridae. Multiple serotypes of this virus are known to be suitable for gene delivery; all known serotypes can infect cells from various tissue types. Non-limiting exemplary serotypes useful for the purposes disclosed herein include any of the 11 serotypes, e.g., AAV2 and AAV8.

The term "adenosine deaminases acting on RNA" or "ADAR" as used herein can refer to an adenosine deaminase that can convert adenosines (A) to inosines (I) in an RNA sequence. ADAR1 and ADAR2 are two exemplary species of ADAR that are involved in mRNA editing in vivo. Non-limiting exemplary sequences for ADAR1 can be found under the following reference numbers: HGNC: 225; Entrez Gene: 103; Ensembl: ENSG 00000160710; OMIM: 146920; UniProtKB: P55265; and GeneCards: GC01M154554, as well as biological equivalents thereof. Non-limiting exemplary sequences for ADAR2 can be found under the following reference numbers: HGNC: 226; Entrez Gene: 104; Ensembl: ENSG00000197381; OMIM: 601218; UniProtKB: P78563; and GeneCards: GC21P045073, as well as biological equivalents thereof. ADAR1 and ADAR2 which are both catalytically active, are found in many different tissue types. ADAR1 has two known isoforms: ADAR1p110 (nucleic acid sequence: SEQ ID NO:5; polypeptide sequence: SEQ ID NO:6), which is localized to the nucleus, and ADAR1p150 (nucleic acid sequence: SEQ ID NO:3; polypeptide sequence: SEQ ID NO:4), which is found in both the nucleus and cytoplasm of cells. The active site of ADAR contains two or three N-terminal dsRNA binding domains (dsRBDs) and a C-terminal catalytic deaminase domain. ADAR1 contains three regions that bind double-stranded helical RNA (dsRBDs) and two Z-DNA binding domains.

The term "ADAR catalytic domain" refers to the portion of an ADAR that comprises the enzyme's C-terminal catalytic deaminase domain. As a non-limiting example, the catalytic deaminase domain of ADAR1 comprises amino acids 886-1221 of SEQ ID NO:4. As another non-limiting example the catalytic deaminase domain of ADAR2 comprises amino acids 316- 697 of SEQ ID NO:2. Further non-limited exemplary sequences of the catalytic domain are provided herein.

ADAR2 comprises the following sequence, wherein bold-underlined sequence reflects the dsRBD domains and the bold-underlined-italicized reflects the catalytic domain and the circled residue depicts a mutation site; ADAR2 (SEQ ID NO:2):

10 20 30 40
MDIEDEENMS SSSTDVKENR NLDNVSPKDG STPGPGEGSQ 50 60 70 80
LSNGGGGGPG RKRPLEEGSN GHSKYRLKKR RKTPGPVLPK

90 100 110 120
NALMQLNEIK PGLQYTLLSQ TGPVHAPLFV MSVEVNGQVF

130 140 150 160
EGSGPTKKKA KLHAAEKALR SFVQFPNASE AHLAMGRTLS 170 180 190 200
VNTDFTSDQA DFPDTLFNGF ETPDKAEPPF YVGSNGDDSF 210 220 230 240
SSSGDLSLSA SPVPASLAQP PLPVLPPFPP PSGKNPVMIL

250 260 270 280
NELRPGLKYD FLSESGESHA KSFVMSVVVD GQFFEGSGRN

290 300 310 320
KKLAKARAAQ SALAAIFNLH LDQTPSRQPI PSEGL*QLHLP*

330 340 350 360
*QVLADAVSRL VLGKFGDLTD NFSSPHARRK VLAGVVMTTG*

370 380 390 400
*TDVKDAKVIS VSTGTKCING EYMSDRGLAL NDCHAEIISR*

410 420 430 440
*RSLLRFLYTQ LELYLNNKDD QKRSIFQKSE RGGFRLKENV*

450 460 470 480
*QFHLYISTSP CGDARIFSPH EPILEEPADR HPNRKARGQL*

490 500 510 520
*RTKIESGEGT IPVRSNASIQ TWDGVLQGER LLTMSCSDKI*

530 540 550 560
*ARMNVVGIQG SLLSIFVEPI YFSSIILGSL YHGDHLSRAM*

570 580 590 600
*YQRISNIEDL PPLYTLNKPL LSGISNAEAR QPGKAPNFSV*

610 620 630 640
*NWTVGDSAIE VINATTGKDE LGRASRLCKH ALYCRWMRVH*

650 660 670 680
*GKVPSHLLRS KITKPNVYHE SKLAAKEYQA AKARLFTAFI*

690 700
*KITKPNVYHE PTEQDQF*SLTP

ADAR1 comprises the following sequence, wherein bold-underlined sequence reflects the dsRBD domains and the bold-underlined-italicized reflects the catalytic domain and the circled residue depicts a mutation site; ADAR1-p150 (SEQ ID NO:4):

10 20 30 40
MNPRQGYSLS GYYTHPFQGY EHRQLRYQQP GPGSSPSSFL 50 60 70 80
LKQIEFLKGQ LPEAPVIGKQ TPSLPPSLPG LRPRFPVLLA

-continued

```
        90        100        110        120
SSTRGRQVDI RGVPRGVHLR SQGLQRGFQH PSPRGRSLPQ

       130        140        150        160
RGVDCLSSHF QELSIYQDQE QRILKFLEEL GEGKATTAHD

       170        180        190        200
LSGKLGTPKK EINRVLYSLA KKGKLQKEAG TPPLWKIAVS

       210        220        230        240
TQAWNQHSGV VRPDGHSQGA PNSDPSLEPE DRNSTSVSED

       250        260        270        280
LLEPFIAVSA QAWNQHSGVV RPDSHSQGSP NSDPGLEPED

       290        300        310        320
SNSTSALEDP LEFLDMAEIK EKICDYLFNV SDSSALNLAK

       330        340        350        360
NIGLTKARDI NAVLIDMERQ GDVYRQGTTP PIWHLTDKKR

       370        380        390        400
ERMQIKRNTN SVPETAPAAI PETKRNAEFL TCNIPTSNAS

       410        420        430        440
NNMVTTEKVE NGQEPVIKLE NRQEARPEPA RLKPPVHYNG

       450        460        470        480
PSKAGYVDFE NGQWATDDIP DDLNSIRAAP GEFRAIMEMP

       490        500        510        520
SFYSHGLPRC SPYKKLTECQ LKNPISGLLE YAQFASQTCE

       530        540        550        560
FNMIEQSGPP HEPRFKFQVV INGREFPPAE AGSKKVAKQD

       570        580        590        600
AAMKAMTILL EEAKAKDSGK SEESSHYSTE KESEKTAESQ

       610        620        630        640
TPTPSATSFF SGKSPVTTLL ECMHKLGNSC EFRLLSKEGP

       650        660        670        680
AHEPKFQYCV AVGAQTFPSV SAPSKKVAKQ MAAEEAMKAL

       690        700        710        720
HGEATNSMAS DNQPEGMISE SLDNLESMMP NKVRKIGELV

       730        740        750        760
RYLNTNPVGG LLEYARSHGF AAEFKLVDQS GPPHEPKFVY

       770        780        790        800
QAKVGGRWFP AVCAHSKKQG KQEAADAALR VLIGENEKAE

       810        820        830        840
RMGFTEVTPV TGASLRRTML LLSRSPEAQP KTLPLTGSTF

       850        860        870        880
HDQIAMLSHR CFNTLTNSFQ PSLLGRKILA AIIMKKDSED

       890        900        910        920
MGVVVSLGTG NRCVKGDSLS LKGETVNDCH AEIISRRGFI

       930        940        950        960
RFLYSELMKY NSQTAKDSIF EPAKGGEKLQ IKKTVSFHLY

       970        980        990       1000
ISTAPCGDGA LFDKSCSDRA MESTESRHYP VFENPKQGKL

      1010       1020       1030       1040
RTKVENGEGT IPVESSDIVP TWDGIRLGER LRTMSCSDKI

      1050       1060       1070       1080
LRWNVLGLQG ALLTHFLQPI YLKSVTLGYL FSQGHLTRAI

      1090       1100       1110       1120
CCRVTRDGSA FEDGLRHPFI VNHPKVGRVS IYDSKRQSGK

      1130       1140       1150       1160
TKETSVNWCL ADGYDLEILD GTRGTVDGPR NELSRVSKKN

      1170       1180       1190       1200
IFLLFKKLCS FRYRRDLLRL SYGEAKKAAR DYETAKNYFK

      1210       1220
KGLKDMGYGN WISKPQEEKN FYLCPV
```

Figure 3A:
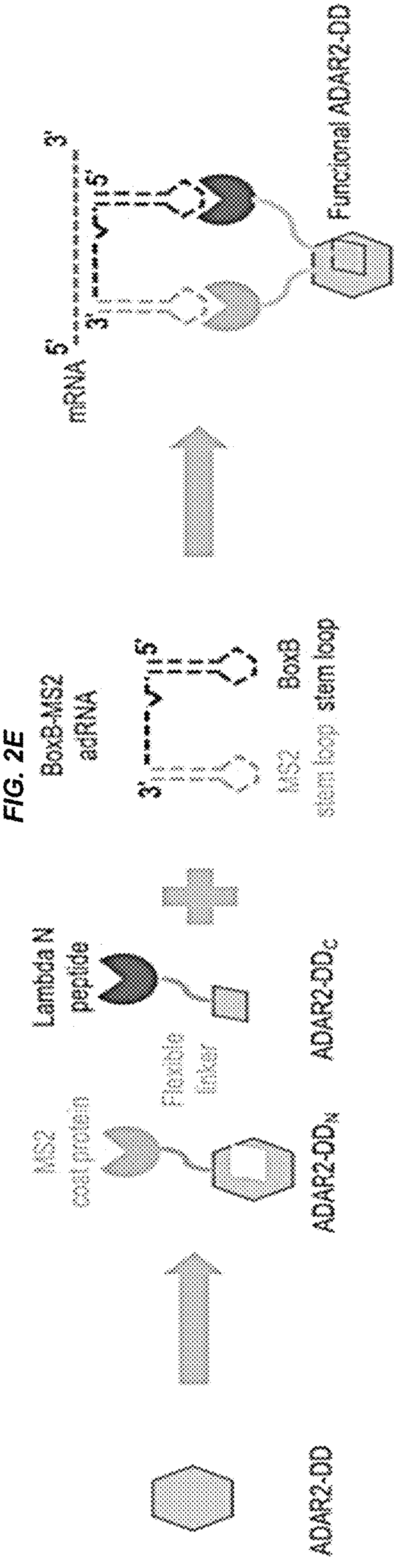
Figure 3C:
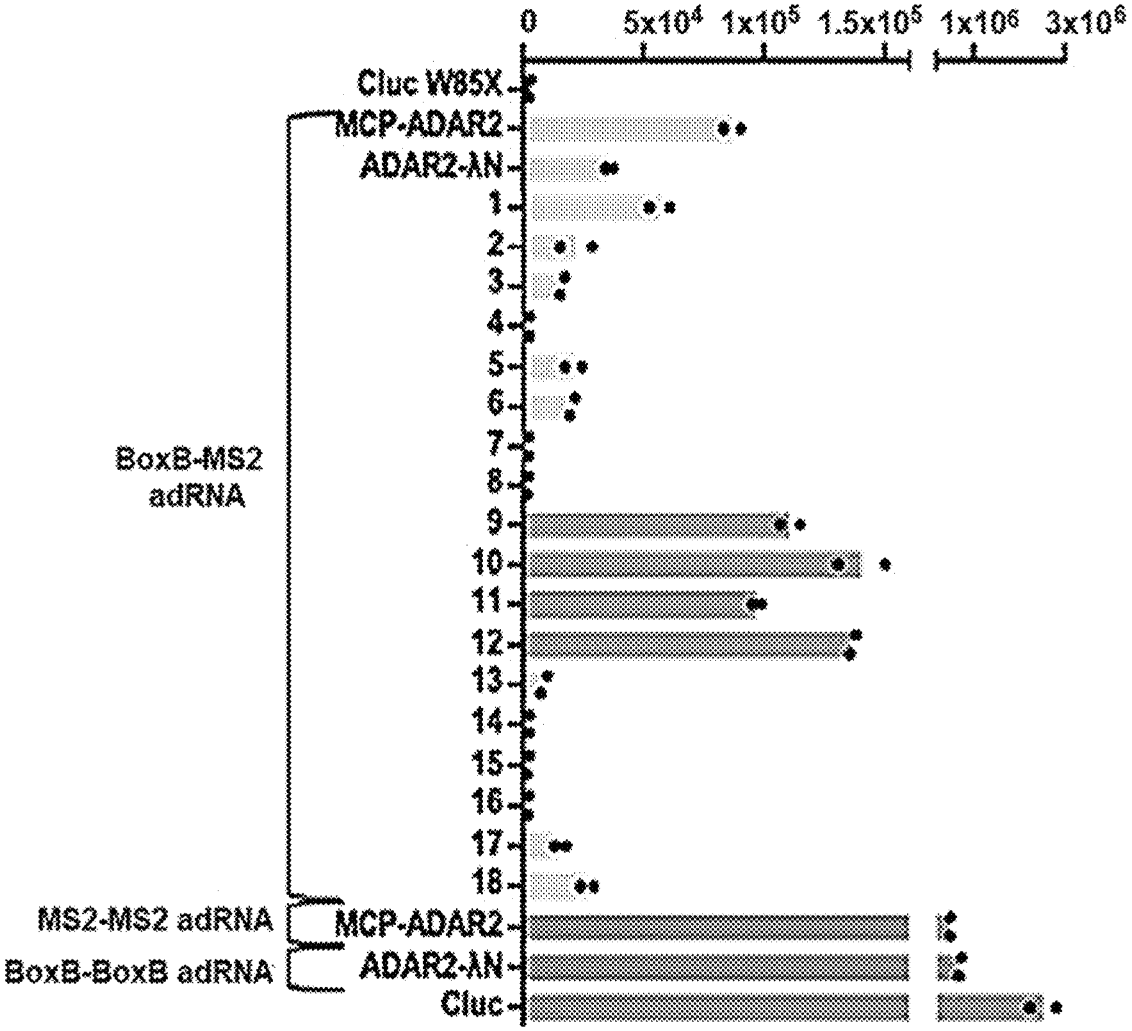
Figure 3D:
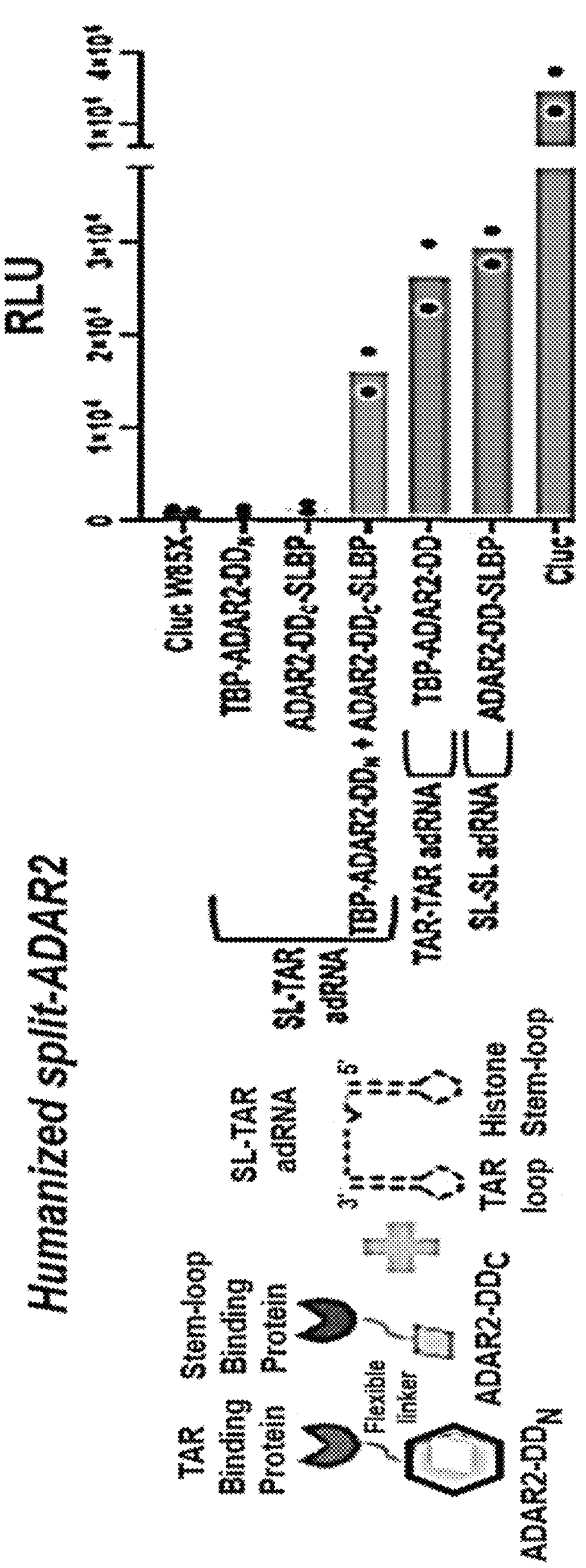

The forward and reverse RNA used to direct site-specific ADAR editing are known as "adRNA" and "radRNA," respectively. adRNA comprises an RNA targeting domain, complementary to the target RNA and one or more ADAR recruiting domain. When bound to its target, the adRNA is able to recruit the ADAR enzyme to the target RNA. This ADAR enzyme is then able to catalyze the conversion of a target adenosine to inosine. In a split-ADAR system, an adRNA will comprise an RNA targeting domain flanked by a first RNA domain that recruits a first adapter or tether protein linked to a first ADAR catalytic domain and by a second RNA domain that recruits a second adapter or tether protein linked to a second ADAR catalytic domain. A structure of an adRNA useful for recruiting split-ADAR proteins comprises (first adapter or tether)-(optional linker)-(RNA targeting domain)-(optional linker)-(second adapter or tether), wherein the first and second adapter/tether are not the same. For example, FIG. 3D depicts a split ADAR comprising a TAR binding protein linked to a first ADAR2 domain and a Stem Loop binding protein linked to a second ADAR2 domain which is targeted using an adRNA comprising a TAR loop-targeting RNA-Histone Stem Loop.

An RNA targeting domain can be complementary to at least a portion of a target RNA. It can be complementary to at least a portion of that target RNA. The portion that can be complementary can be from about 50 basepairs (bp) to about 200 bp in length. The portion that can be complementary can be from about 20 bp to about 100 bp in length. The portion that can be complementary can be from about 10 bp to about 50 bp in length. The portion that can be complementary can be from about 50 bp to about 300 bp in length. The portion can be at least about 40 bp, 41 bp, 42 bp, 43 bp, 44 bp, 45 bp, 46 bp, 47 bp, 48 bp, 49 bp, 50 bp, 51 bp, 52 bp, 53 bp, 54 bp, 55 bp, 56 bp, 57 bp, 58 bp, 59 bp, 60 bp, 61 bp, 62 bp, 63 bp, 64 bp, 65 bp, 66 bp, 67 bp, 68 bp, 69 bp, 70 bp, 71 bp, 72 bp, 73 bp, 74 bp, 75 bp, 76 bp, 77 bp, 78 bp, 79 bp, 80 bp, 81 bp, 82 bp, 83 bp, 84 bp, 85 bp, 86 bp, 87 bp, 88 bp, 89 bp, 90 bp, 91 bp, 92 bp, 93 bp, 94 bp, 95 bp, 96 bp, 97 bp, 98 bp, 99 bp, 100 bp, 101 bp, 102 bp, 103 bp, 104 bp, 105 bp, 106 bp, 107 bp, 108 bp, 109 bp, 110 bp, 111 bp, 112 bp, 113 bp, 114 bp, 115 bp, 116 bp, 117 bp, 118 bp, 119 bp, 120 bp, 121 bp, 122 bp, 123 bp, 124 bp, 125 bp, 126 bp, 127 bp, 128 bp, 129 bp, 130 bp, 131 bp, 132 bp, 133 bp, 134 bp, 135 bp, 136 bp, 137 bp, 138 bp, 139 bp, 140 bp, 141 bp, 142 bp, 143 bp, 144 bp, 145 bp, 146 bp, 147 bp, 148 bp, 149 bp, or 150 bp. Modifying a length of the portion that is complementary can enhance efficiency of editing. In some cases, longer lengths of the portion can enhance efficiency of editing as compared to shorter lengths.

An RNA targeting domain when bound to a target RNA can produce a double stranded nucleic acid which is a substrate for the engineered polypeptides described herein. In some instances, the targeting domain comprises a mismatched nucleotide opposite an adenosine to be edited in the targeting domain when the targeting domain is bound to the target RNA to produce the double stranded substrate. In some embodiments, the mismatched nucleotide is a cytosine opposite the adenosine to be edited.

The position of the mismatched nucleotide in the RNA targeting domain can be varied across the length of the RNA targeting domain. In some cases, the mismatched nucleotide can be position at about 1 nt, 2 nt, 3 nt, 4 nt, 5 nt, 6 nt, 7 nt, 8 nt, 9 nt, 10 nt, 11 nt, 12 nt, 13 nt, 14 nt, 15 nt, 16 nt, 17 nt, 18 nt, 19 nt, 20 nt, 21 nt, 22 nt, 23 nt, 24 nt, 25 nt, 26 nt, 27 nt, 28 nt, 29 nt, 30 nt, 31 nt, 32 nt, 33 nt, 34 nt, 35 nt, 36 nt, 37 nt, 38 nt, 39 nt, 40 nt, 41 nt, 42 nt, 43 nt, 44 nt, 45 nt, 46 nt, 47 nt, 48 nt, 49 nt, 50 nt, 51 nt, 52 nt, 53 nt, 54 nt, 55 nt, 56 nt, 57 nt, 58 nt, 59 nt, 60 nt, 61 nt, 62 nt, 63 nt, 64 nt, 65 nt, 66 nt, 67 nt, 68 nt, 69 nt, 70 nt, 71 nt, 72 nt, 73 nt, 74 nt, 75 nt, 76 nt, 77 nt, 78 nt, 79 nt, 80 nt, 81 nt, 82 nt, 83 nt, 84 nt, 85 nt, 86 nt, 87 nt, 88 nt, 89 nt, 90 nt, 91 nt, 92 nt, 93 nt, 94 nt, 95 nt, 96 nt, 97 nt, 98 nt, 99 nt, 100 nt, 101 nt, 102 nt, 103 nt, 104 nt, 105 nt, 106 nt, 107 nt, 108 nt, 109 nt, 110 nt, 111 nt, 112 nt, 113 nt, 114 nt, 115 nt, 116 nt, 117 nt, 118 nt, 119 nt, 120 nt, 121 nt, 122 nt, 123 nt, 124 nt, 125 nt, 126 nt, 127 nt, 128 nt, 129 nt, 130 nt, 131 nt, 132 nt, 133 nt, 134 nt, 135 nt, 136 nt, 137 nt, 138 nt, 139 nt, 140 nt, 141 nt, 142 nt, 143 nt, 144 nt, 145 nt, 146 nt, 147 nt, 148 nt, 149 nt, or 150 nt from a 5' end of the targeting domain.

The catalytic domains of ADAR2 are comprised in the sequences provided herein. Wildtype ADARs are naturally occurring RNA editing enzymes that catalyze the hydrolytic deamination of adenosine to inosine that is biochemically recognized as guanosine.

As used herein, the term "comprising" is intended to mean that the compositions and methods include the recited elements, but do not exclude others. Unless otherwise indicated, open terms for example "contain," "containing," "include," "including," and the like mean comprising. "Consisting essentially of" when used to define compositions and methods, shall mean excluding other elements of any essential significance to the combination for the intended use. Thus, a composition consisting essentially of the elements as defined herein may not exclude trace contaminants from the isolation and purification method and pharmaceutically acceptable carriers, such as phosphate buffered saline, preservatives, and the like. "Consisting of" shall mean excluding more than trace elements of other ingredients and substantial method steps for administering the compositions of this disclosure. Embodiments defined by each of these transition terms are within the scope of this disclosure.

"Canonical amino acids" refer to those 20 amino acids found naturally in the human body shown in the table below with each of their three letter abbreviations, one letter abbreviations, structures, and corresponding codons:

| non-polar, aliphatic residues | | | | |
|---|---|---|---|---|
| Glycine | Gly | G | 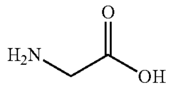 | GGU GGC GGA GGG |
| Alanine | Ala | A | 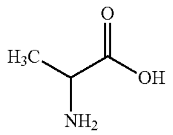 | GCU GCC GCA GCG |
| Valine | Val | V | 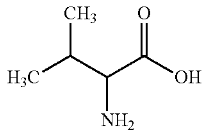 | GUU GUC GUA GUG |
| Leucine | Leu | L | 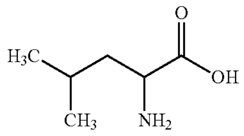 | UUA UUG CUU CUC CUA CUG |
| Isoleucine | Ile | I | 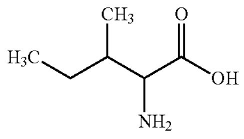 | AUU AUC AUA |
| Proline | Pro | P | 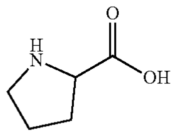 | CCU CCC CCA CCG |

-continued
| | | | | |
|---|---|---|---|---|
| aromatic residues | | | | |
| Phenylalanine | Phe | F | 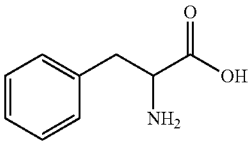 [SMILES: NC(Cc1ccccc1)C(=O)O] | UUU UUC |
| Tyrosine | Tyr | Y | 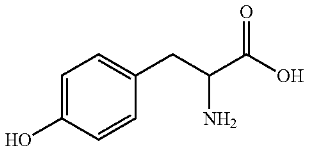 [SMILES: NC(Cc1ccc(O)cc1)C(=O)O] | UAU UAC |
| Tryptophan | Trp | W | 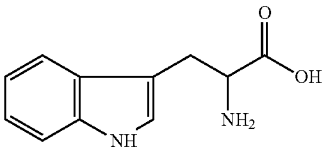 [SMILES: NC(Cc1c[nH]c2ccccc12)C(=O)O] | UGG |
| polar, non-charged residues | | | | |
| Serine | Ser | S | 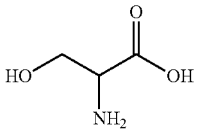 | UCU UCC UCA UCG AGU AGC |
| Threonine | Thr | T | 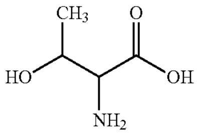 | ACU ACC ACA ACG |
| Cysteine | Cys | C | 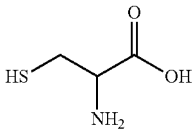 | UGU UGC |
| Methionine | Met | M | 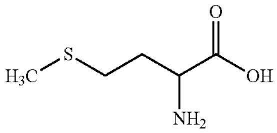 | AUG |
| Asparagine | Asn | N | 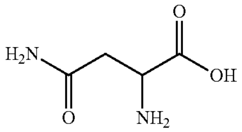 | AAU AAC |
| Glutamine | Gln | Q | 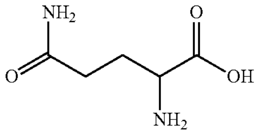 | CAA CAG |
| positively charged residues | | | | |
| Lysine | Lys | K | 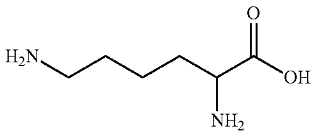 | AAA AAG |

-continued

| | | | | |
|---|---|---|---|---|
| Arginine | Arg | R | 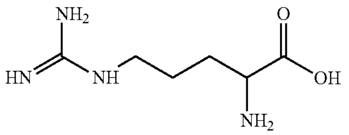 [SMILES: N=C(N)NCCCC(N)C(=O)O] | CGU CGC CGA CGG AGA AGG |
| Histidine | His | H | 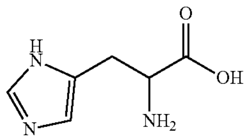 [SMILES: NC(Cc1cnc[nH]1)C(=O)O] | CAU CAC |
| negatively charged residues | | | | |
| Aspartate | Asp | D | 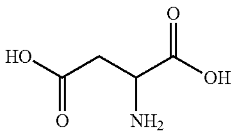 | GAU GAC |
| Glutamate | Glu | E | 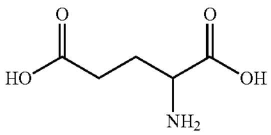 | GAA GAG |

As used herein, the term "Cas" refers to a protein of the CRISPR/Cas system or complex. The term "Cas9" can refer to a CRISPR associated endonuclease referred to by this name. Non-limiting exemplary Cas9s include *Staphylococcus aureus* Cas9, nuclease dead Cas9, and orthologs and biological equivalents each thereof. Orthologs include but are not limited to *Streptococcus pyogenes* Cas9 ("spCas9"), Cas9 from *Streptococcus* thermophiles, *Legionella* pneumophilia, *Neisseria lactamica, Neisseria meningitides, Francisella novicida*; and Cpf1 (which performs cutting functions analogous to Cas9) from various bacterial species including Acidaminococcus spp. and *Francisella novicida* U112. For example, UniProtKB G3ECR1 (CAS9_STRTR)) as well as dead Cas9 or dCas9, which lacks endonuclease activity (e.g., with mutations in both the RuvC and HNH domain) can be used. The term "Cas9" may further refer to equivalents of the referenced Cas9 having at least about 60%, 65%, 70%, 75%, 80%, 85%, 90%, 95%, or 99% identity thereto, including but not limited to other large Cas9 proteins. In some embodiments, the Cas9 is derived from *Campylobacter jejuni* or another Cas9 orthologs 1000 amino acids or less in length.

The term "Cas13" or "dCas13" includes the nuclease from the bacterium L. shahii. dCas13 is a catalytically-inactive Cas13 that can be used to direct ADARs to transcripts for editing.

"Conservative amino acid substitution" or, simply, "conservative variations" of a particular sequence refers to the replacement of one amino acid, or series of amino acids, with essentially identical amino acid sequences. One of skill will recognize that individual substitutions, deletions or additions which alter, add or delete a single amino acid or a percentage of amino acids in an encoded sequence result in "conservative variations" where the alterations result in the deletion of an amino acid, addition of an amino acid, or substitution of an amino acid with a chemically similar amino acid.

Conservative substitution tables include providing functionally similar amino acids. For example, one conservative substitution group includes Alanine (A), Serine (S), and Threonine (T). Another conservative substitution group includes Aspartic acid (D) and Glutamic acid (E). Another conservative substitution group includes Asparagine (N) and Glutamine (Q). Yet another conservative substitution group includes Arginine (R) and Lysine (K). Another conservative substitution group includes Isoleucine, (I) Leucine (L), Methionine (M), and Valine (V). Another conservative substitution group includes Phenylalanine (F), Tyrosine (Y), and Tryptophan (W).

As used herein, the term "CRISPR" can refer to a technique of sequence specific genetic manipulation relying on the clustered regularly interspaced short palindromic repeats pathway. CRISPR can be used to perform gene editing and/or gene regulation, as well as to simply target proteins to a specific genomic location.

"Gene editing" can refer to a type of genetic engineering in which the nucleotide sequence of a target polynucleotide is changed through introduction of deletions, insertions, single stranded or double stranded breaks, or base substitutions to the polynucleotide sequence. In some aspect, CRISPR-mediated gene editing utilizes the pathways of nonhomologous end-joining (NHEJ) or homologous recombination to perform the edits. ADAR proteins can also be considered as a type of gene editing by chemically changing nucleotides in RNA sequence thereby changing the encoded codon or stop signal. Gene regulation can refer to increasing or decreasing the production of specific gene products such as protein or RNA.

As used herein, the term "detectable marker" can refer to at least one marker capable of directly or indirectly, producing a detectable signal. A non-exhaustive list of such a marker includes enzymes which produce a detectable signal, for example by colorimetry, fluorescence, luminescence, such as horseradish peroxidase, alkaline phosphatase, β-galactosidase, glucose-6-phosphate dehydrogenase, chromophores such as fluorescent, luminescent dyes, groups with electron density detected by electron microscopy or by their electrical property such as conductivity, amperometry, voltammetry, impedance, detectable groups, for example whose molecules are of sufficient size to induce detectable modifications in their physical and/or chemical properties, such detection can be accomplished by optical methods such as diffraction, surface plasmon resonance, surface variation, the contact angle change or physical methods such as atomic force spectroscopy, tunnel effect, or radioactive molecules such as $^{32}P$, $^{35}S$ or $^{125}I$.

As used herein, the term "domain" can refer to a particular region of a protein or polypeptide and is associated with a particular function. For example, "a domain which associates with an RNA hairpin motif" can refer to the domain of a protein that binds one or more RNA hairpin. This binding can optionally be specific to a particular hairpin. A "catalytic domain" can refer to that particular section or amino acid subsequence found in a protein that catalyzes a particular activity (e.g., the enzymatic pocket) of protein.

The term "effective amount" can refer to a quantity sufficient to achieve a desired effect. In the context of therapeutic or prophylactic applications, the effective amount will depend on the type and severity of the condition at issue and the characteristics of the individual subject, such as general health, age, sex, body weight, and tolerance to pharmaceutical compositions. In the context of a gene editing system and effective amount is that amount of an enzyme (e.g., ADAR) to cause the desired editing of a genetic site in a target nucleic acid. The effective amount of editing can be measured by the level of mutation load in the subject and/or can be measured by a change in a disease marker associated with an unedited mutation.

The term "encode" as it is applied to polynucleotides can refer to a polynucleotide which is said to "encode" a polypeptide if, in its native state or when manipulated, it can be transcribed and/or translated to produce the mRNA for the polypeptide and/or a fragment thereof. The antisense strand is the complement of such a nucleic acid, and the encoding sequence can be deduced therefrom.

The terms "equivalent" or "biological equivalent" are used interchangeably when referring to a particular molecule, biological, or cellular material describes a material having minimal homology while still maintaining a desired structure or functionality. An equivalent in this context does not necessarily mean a 100% exact equivalent, but rather a material that has a measureable structure of function that does not differ by such extent as to be considered non-functional for an intended purpose. It is to be inferred without explicit recitation and unless otherwise intended, that when the disclosure relates to a polypeptide, protein, polynucleotide or antibody, an equivalent or a biologically equivalent of such is intended within the scope of this disclosure. Unless specifically recited herein, it is contemplated that any polynucleotide, polypeptide or protein mentioned herein also includes equivalents thereof. For example, an equivalent intends at least about 70% homology or identity, or at least 80% homology or identity and alternatively, or at least about 85%, or alternatively at least about 90%, or alternatively at least about 95%, or alternatively 98% percent homology or identity and exhibits substantially equivalent biological activity to the reference protein, polypeptide or nucleic acid. Alternatively, when referring to polynucleotides, an equivalent thereof is a polynucleotide that hybridizes under stringent conditions to the reference polynucleotide or its complement.

"Eukaryotic cells" comprise all of the life kingdoms except monera. They can be easily distinguished through a membrane-bound nucleus. Animals, plants, fungi, and protists are eukaryotes or organisms whose cells are organized into complex structures by internal membranes and a cytoskeleton. The most characteristic membrane-bound structure is the nucleus. Unless specifically recited, the term "host" includes a eukaryotic host, including, e.g., yeast, higher plant, insect and mammalian cells. Non-limiting examples of eukaryotic cells or hosts include simian, bovine, porcine, murine, rat, avian, reptilian and human.

As used herein, "expression" can refer to the process by which polynucleotides are transcribed into mRNA and/or the process by which the transcribed mRNA is subsequently being translated into peptides, polypeptides, or proteins. If the polynucleotide is derived from genomic DNA, expression can include splicing of the mRNA in a eukaryotic cell.

As used herein, the term "functional" can be used to modify any molecule, biological, or cellular material to intend that it accomplishes a particular, specified effect.

The terms "hairpin," "hairpin loop," "stem loop," and/or "loop" used alone or in combination with "motif" is used in context of an oligonucleotide to refer to a structure formed in single stranded oligonucleotide when sequences within the single strand which are complementary when read in opposite directions base pair to form a region whose conformation resembles a hairpin or loop.

"Homology" or "identity" or "similarity" can refer to sequence similarity between two peptides or polypeptide or between two nucleic acid molecules. Homology can be determined by comparing a position in each sequence which can be aligned for purposes of comparison. When a position in the compared sequence is occupied by the same base or amino acid, then the molecules are homologous at that position. A degree of homology between sequences is a function of the number of matching or homologous positions shared by the sequences. An "unrelated" or "non-homologous" sequence shares less than 40% identity, or alternatively less than 25% identity, with one of the sequences of the disclosure.

Homology refers to a % identity of a sequence to a reference sequence. As a practical matter, any particular sequence can be at least 50%, 60%, 70%, 80%, 85%, 90%, 92%, 95%, 96%, 97%, 98% or 99% identical to any sequence described herein, which can correspond with a particular nucleic acid sequence described herein or a particular polypeptide sequence described herein. Percent identity can be determined conventionally using known computer programs such the Bestfit program (Wisconsin Sequence Analysis Package, Version 8 for Unix, Genetics Computer Group, University Research Park, 575 Science Drive, Madison, Wis. 53711). When using Bestfit or any other sequence alignment program to determine whether a particular sequence is, for instance, 95% identical to a reference sequence, the parameters can be set such that the percentage of identity is calculated over the full length of the reference sequence and that gaps in homology of up to 5% of the total reference sequence are allowed.

For example, in a specific embodiment the identity between a reference sequence (query sequence, i.e., a sequence of the disclosure) and a subject sequence, also referred to as a global sequence alignment, can be determined using the FASTDB computer program based on the algorithm of Brutlag et al. (Comp. App. Biosci. 6:237-245 (1990)). In some cases, parameters for a particular embodiment in which identity is narrowly construed, used in a FASTDB amino acid alignment, can include: Scoring Scheme=PAM (Percent Accepted Mutations) 0, k-tuple=2, Mismatch Penalty=1, Joining Penalty=20, Randomization Group Length=0, Cutoff Score=1, Window Size=sequence length, Gap Penalty=5, Gap Size Penalty=0.05, Window Size=500 or the length of the subject sequence, whichever is shorter. According to this embodiment, if the subject sequence is shorter than the query sequence due to N- or C-terminal deletions, not because of internal deletions, a manual correction can be made to the results to take into consideration the fact that the FASTDB program does not account for N- and C-terminal truncations of the subject sequence when calculating global percent identity. For subject sequences truncated at the N- and C-termini, relative to the query sequence, the percent identity can be corrected by calculating the number of residues of the query sequence that are lateral to the N- and C-terminal of the subject sequence, which are not matched/aligned with a corresponding subject residue, as a percent of the total bases of the query sequence. A determination of whether a residue is matched/aligned can be determined by results of the FASTDB sequence alignment. This percentage can be then subtracted from the percent identity, calculated by the FASTDB program using the specified parameters, to arrive at a final percent identity score. This final percent identity score can be used for the purposes of this embodiment. In some cases, only residues to the N- and C-termini of the subject sequence, which are not matched/aligned with the query sequence, are considered for the purposes of manually adjusting the percent identity score. That is, only query residue positions outside the farthest N- and C-terminal residues of the subject sequence are considered for this manual correction. For example, a 90 residue subject sequence can be aligned with a 100 residue query sequence to determine percent identity. The deletion occurs at the N-terminus of the subject sequence and therefore, the FASTDB alignment does not show a matching/alignment of the first 10 residues at the N-terminus. The 10 unpaired residues represent 10% of the sequence (number of residues at the N- and C-termini not matched/total number of residues in the query sequence) so 10% is subtracted from the percent identity score calculated by the FASTDB program. If the remaining 90 residues were perfectly matched the final percent identity can be 90%. In another example, a 90 residue subject sequence is compared with a 100 residue query sequence. This time the deletions are internal deletions so there are no residues at the N- or C-termini of the subject sequence which are not matched/aligned with the query. In this case the percent identity calculated by FASTDB is not manually corrected. Once again, only residue positions outside the N- and C-terminal ends of the subject sequence, as displayed in the FASTDB alignment, which are not matched/aligned with the query sequence are manually corrected for. The reference sequence can be obtained from a database such as the NCBI Reference Sequence Database (RefSeq) database. In certain cases, where a polypeptide comprises various function domains (e.g., dsRBD and catalytic domain as in ADAR), the percent identity can be with respect to a particular domain (e.g., the catalytic domain) while ignoring the sequence associated with the non-aligned domain.

"Hybridization" can refer to a reaction in which one or more polynucleotides react to form a complex that is stabilized via hydrogen bonding between the bases of the nucleotide residues. The hydrogen bonding can occur by Watson-Crick base pairing, Hoogstein binding, or in any other sequence-specific manner. The complex can comprise two strands forming a duplex structure, three or more strands forming a multi-stranded complex, a single self-hybridizing strand, or any combination of these. A hybridization reaction can constitute a step in a more extensive process, such as the initiation of a PC reaction, or the enzymatic cleavage of a polynucleotide by a ribozyme.

Examples of stringent hybridization conditions include: incubation temperatures of about 25° C. to about 37° C.; hybridization buffer concentrations of about 6×SSC to about 10×SSC; formamide concentrations of about 0% to about 25%; and wash solutions from about 4×SSC to about 8×SSC. Examples of moderate hybridization conditions include: incubation temperatures of about 40° C. to about 50° C.; buffer concentrations of about 9×SSC to about 2×SSC; formamide concentrations of about 30% to about 50%; and wash solutions of about 5×SSC to about 2×SSC. Examples of high stringency conditions include: incubation temperatures of about 55° C. to about 68° C.; buffer concentrations of about 1×SSC to about 0.1×SSC; formamide concentrations of about 55% to about 75%; and wash solutions of about 1×SSC, 0.1×SSC, or deionized water. In general, hybridization incubation times are from 5 minutes to 24 hours, with 1, 2, or more washing steps, and wash incubation times are about 1, 2, or 15 minutes. SSC is 0.15 M NaCl and 15 mM citrate buffer. It is understood that equivalents of SSC using other buffer systems can be employed.

The term "isolated" as used herein can refer to molecules or biologicals or cellular materials being substantially free from other materials. In one aspect, the term "isolated" can refer to nucleic acid, such as DNA or RNA, or protein or polypeptide (e.g., an antibody or derivative thereof), or cell or cellular organelle, or tissue or organ, separated from other DNAs or RNAs, or proteins or polypeptides, or cells or cellular organelles, or tissues or organs, respectively, that are present in the natural source. The term "isolated" also can refer to a nucleic acid or peptide that is substantially free of cellular material, viral material, or culture medium when produced by recombinant DNA techniques, or chemical precursors or other chemicals when chemically synthesized. Moreover, an "isolated nucleic acid" is meant to include nucleic acid fragments which are not naturally occurring as fragments and may not be found in the natural state. The term "isolated" is also used herein to refer to polypeptides which are isolated from other cellular proteins and is meant to encompass both purified and recombinant polypeptides. The term "isolated" is also used herein to refer to cells or tissues that are isolated from other cells or tissues and is meant to encompass both cultured and engineered cells or tissues.

"LambdaN" or "λN" refers to the N protein from lambdoid phages. The N protein can have a sequence a sequence selected from the group consisting of SEQ ID NO:16, 18, 20 and 22. The N protein binds to the nutL BoxB sequence or the nutR BoxB sequence. The nutL BoxB sequence comprises GCCCUGAAGAAGGGC (SEQ ID NO:23), while the nutR BoxB sequence comprises GCCCUGAAAAAGGGC (SEQ ID NO:24).

The term "lentivirus" as used herein refers to a member of the class of viruses associated with this name and belonging to the genus lentivirus, family Retroviridae. While some lentiviruses are known to cause diseases, other lentivirus are known to be suitable for gene delivery. See, e.g., Tomás et al. (2013) Biochemistry, Genetics and Molecular Biology: "Gene Therapy—Tools and Potential Applications," ISBN 978-953-51-1014-9.

"MS2" or "MS2 coat protein" refers to the coat protein from RNA bacteriophages. The MS2 coat protein is a small 129 amino acid, 14 kDa protein that binds to small RNA hairpins. The MS2 coat protein has the sequence of SEQ ID NO:4 and can bind to RNA hairpin sequences having the sequence ACAUGAGGAUUACCCAUG (SEQ ID NO:13) or ACAUGAGGAUCACCCAUG (SEQ ID NO:14). The difference between SEQ ID NO:13 and 14 is a single U to C substitution in the loop that increases the binding affinity by 50-fold over SEQ ID NO:13.

"Messenger RNA" or "mRNA" is a nucleic acid molecule that is transcribed from DNA and then processed to remove non-coding sections known as introns. The resulting mRNA is exported from the nucleus (or another locus where the DNA is present) and translated into a protein. The term "pre-mRNA" can refer to the strand prior to processing to remove non-coding sections.

The term "mutation" as used herein, can refer to an alteration to a nucleic acid sequence encoding a protein relative to the consensus sequence of said protein by any process or mechanism. This includes any mutation in which a protein, enzyme, polynucleotide, or gene sequence is altered, and any detectable change in a cell arising from such a mutation. Typically, a mutation occurs in a polynucleotide or gene sequence, by point mutations, deletions, or insertions of single or multiple nucleotide residues. "Missense" mutations result in the substitution of one codon for another; "nonsense" mutations change a codon from one encoding a particular amino acid to a stop codon. Nonsense mutations often result in truncated translation of proteins. "Silent" mutations are those which have no effect on the resulting protein. As used herein the term "point mutation" can refer to a mutation affecting only one nucleotide in a gene sequence. "Splice site mutations" are those mutations present pre-mRNA (prior to processing to remove introns) resulting in mistranslation and often truncation of proteins from incorrect delineation of the splice site. A mutation can comprise a single nucleotide variation (SNV). A mutation can comprise a sequence variant, a sequence variation, a sequence alteration, or an allelic variant. The reference DNA sequence can be obtained from a reference database. A mutation can affect function. A mutation may not affect function. A mutation can occur at the DNA level in one or more nucleotides, at the ribonucleic acid (RNA) level in one or more nucleotides, at the protein level in one or more amino acids, or any combination thereof. Specific changes that can constitute a mutation can include a substitution, a deletion, an insertion, an inversion, or a conversion in one or more nucleotides or one or more amino acids. A mutation can be a point mutation. A mutation can be a fusion gene. A fusion pair or a fusion gene can result from a mutation, such as a translocation, an interstitial deletion, a chromosomal inversion, or any combination thereof. A mutation can constitute variability in the number of repeated sequences, such as triplications, quadruplications, or others. For example, a mutation can be an increase or a decrease in a copy number associated with a given sequence (copy number variation, or CNV). A mutation can include two or more sequence changes in different alleles or two or more sequence changes in one allele. A mutation can include two different nucleotides at one position in one allele, such as a mosaic. A mutation can include two different nucleotides at one position in one allele, such as a chimeric. A mutation can be present in a malignant tissue. A presence or an absence of a mutation can indicate an increased risk to develop a disease or condition. A presence or an absence of a mutation can indicate a presence of a disease or condition. A mutation can be present in a benign tissue. Absence of a mutation can indicate that a tissue or sample is benign. As an alternative, absence of a mutation may not indicate that a tissue or sample is benign. Methods as described herein can comprise identifying a presence of a mutation in a sample.

A "mutant", "variant" or "modified" protein, enzyme, polynucleotide, gene, or cell, means a protein, enzyme, polynucleotide, gene, or cell, that has been altered or derived, or is in some way different or changed, from a parent protein or wild-type protein, enzyme, polynucleotide, gene, or cell. A mutant or modified protein or enzyme is usually, although not necessarily, expressed from a mutant polynucleotide or gene. The variant or mutant polypeptide can result from a point mutation or deletion. In some instances, a mutant or variant protein is engineered by mutating one or more nucleotides in a codon of a polynucleotide encoding a protein or polypeptide. A mutant protein or polypeptide can comprise a plurality of mutations compared to a wild-type or parental protein or polypeptide. For example, a mutant protein or polypeptide can comprise 1, 2, 3, 4, 5, 10, 15, 20 or 30 or more mutations relative to a parental or wild-type protein or polypeptide.

The term "non-canonical amino acids" can refer to those synthetic or otherwise modified amino acids that fall outside this group, typically generated by chemical synthesis or modification of canonical amino acids (e.g. amino acid analogs). The disclosure employs proteinogenic non-canonical amino acids in some of the methods and vectors disclosed herein. A non-limiting exemplary non-canonical amino acid is pyrrolysine (Pyl or O), the chemical structure of which is provided below:

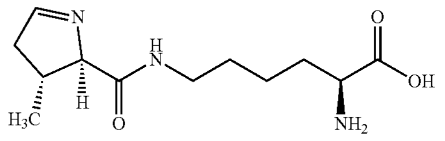 [SMILES: C[C@@H]1CC=N[C@H]1C(=O)NCCCC[C@H](N)C(=O)O]

Inosine (I) is another exemplary non-canonical amino acid, which can be found in tRNA and is essential for proper translation according to "wobble base pairing." The structure of inosine is provided above.

Non-limiting examples of a modified amino acid include a glycosylated amino acid, a sulfated amino acid, a prenlyated (e.g., farnesylated, geranylgeranylated) amino acid, an acetylated amino acid, an acylated amino acid, a pegylated amino acid, a biotinylated amino acid, a carboxylated amino acid, a phosphorylated amino acid, and the like. References adequate to guide one of skill in the modification of amino acids are replete throughout the literature. Example protocols are found in Walker (1998) Protein Protocols on CD-ROM (Humana Press, Towata, N.J.).

A "parent" protein, enzyme, polynucleotide, gene, or cell, is any protein, enzyme, polynucleotide, gene, or cell, from which any other protein, enzyme, polynucleotide, gene, or cell, is derived or made, using any methods, tools or techniques, and whether or not the parent is itself native or mutant. A parent polynucleotide or gene encodes for a parent protein or enzyme.

The term "protein", "peptide" and "polypeptide" are used interchangeably and in their broadest sense to refer to a compound of two or more subunit amino acids, amino acid analogs or peptidomimetics. The subunits can be linked by peptide bonds. In another embodiment, the subunit can be linked by other bonds, e.g., ester, ether, etc. A protein or peptide can contain at least two amino acids and no limitation is placed on the maximum number of amino acids which can comprise a protein's or peptide's sequence. As used herein the term "amino acid" can refer to either natural and/or unnatural or synthetic amino acids, including glycine and both the D and L optical isomers, amino acid analogs and peptidomimetics. As used herein, the term "fusion protein" can refer to a protein comprised of domains from more than one naturally occurring or recombinantly produced protein, where generally each domain serves a different function. In this regard, the term "linker" can refer to a polypeptide fragment that is used to link these domains together—optionally to preserve the conformation of the fused protein domains and/or prevent unfavorable interactions between the fused protein domains which can compromise their respective functions.

The terms "polynucleotide" and "oligonucleotide" are used interchangeably and refer to a polymeric form of nucleotides of any length, either deoxyribonucleotides or ribonucleotides or analogs thereof. Polynucleotides can have any three-dimensional structure and can perform any function, known or unknown. The following are non-limiting examples of polynucleotides: a gene or gene fragment (for example, a probe, primer, EST or SAGE tag), exons, introns, messenger RNA (mRNA), transfer RNA, ribosomal RNA, RNAi, ribozymes, cDNA, recombinant polynucleotides, branched polynucleotides, plasmids, vectors, isolated DNA of any sequence, isolated RNA of any sequence, nucleic acid probes and primers. A polynucleotide can comprise modified nucleotides, such as methylated nucleotides and nucleotide analogs. If present, modifications to the nucleotide structure can be imparted before or after assembly of the polynucleotide. The sequence of nucleotides can be interrupted by non-nucleotide components. A polynucleotide can be further modified after polymerization, such as by conjugation with a labeling component. The term also can refer to both double- and single-stranded molecules. Unless otherwise specified or required, any embodiment of this disclosure that is a polynucleotide encompasses both the double-stranded form and each of two complementary single-stranded forms known or predicted to make up the double-stranded form.

A polynucleotide is composed of a specific sequence of four nucleotide bases: adenine (A); cytosine (C); guanine (G); thymine (T); and uracil (U) for thymine when the polynucleotide is RNA. In some embodiments, the polynucleotide can comprise one or more other nucleotide bases, such as inosine (I), a nucleoside formed when hypoxanthine is attached to ribofuranose via a β-N9-glycosidic bond, resulting in the chemical structure:

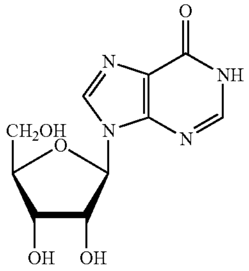

Inosine is read by the translation machinery as guanine (G).

The term "polynucleotide sequence" is the alphabetical representation of a polynucleotide molecule. This alphabetical representation can be input into databases in a computer having a central processing unit and used for bioinformatics applications such as functional genomics and homology searching.

A polynucleotide sequence can be derived from a known polypeptide sequence using well-known codon tables. An amino acid in a polypeptide can be encoded by more than one codon due to the degeneracy of the genetic code. A polynucleotide sequence can be deduced from a polypeptide sequence using various computer algorithms or by hand using a codon table. Moreover, because of the degeneracy of the genetic code, optimized codon (e.g., codon-bias for various organisms) can be used when expression of a deduced polynucleotide is to be used in an organism that does not normally produce the particular polypeptide.

As used herein, "PP7" refers to coat protein of the single stranded RNA bacteriophage of *P. aeruginosa*. The PP7 coat protein (SEQ ID NO:25) binds to a hairpin RNA having the sequence UAAGGAGUUUAUAUGGAAACCCUUA (SEQ ID NO:26). RNA recognitions sites and mutagenesis of PP7 are described in Lim et al., Nucleic Acids Res., 30(19):4138-4144, 2002, which is incorporated herein by reference.

A "PUF domain" or "Pumillio Domain" or "Pumby Sequence" refer to RNA-binding protein *Pumilio* that can be concatenated into chains of varying composition and length to target different bases in a nucleotide sequence. When bound into a chain, each module has a preferred affinity for a specific RNA base (see also, U.S. Pat. Publ. No. US20160238593A1 which is incorporated herein by reference in its entirety). The following Table 1 provides sequences that contain cloning overhangs used to assemble hexamers for Pumby:

TABLE 1

| |
|---|
| module1 - hex1 A |
| GTCATGCGTCTCCAGGTCGATAGTAGCGGTCTCCCGAGGCGAACTTCACCAGCAC |
| ACTGAACAACTCGTGCAAGACCAGTATGGGTGCTATGTCATCCAACATGTCCTTG |
| AGCACGGACGCCC CGAAGACAAGTCAAAGATCGTGGCTGGAGACGGAGTGT |
| module1 - hex1 C |
| GTCATGCGTCTCCAGGTCGATAGTAGCGGTCTCCCGAGGCGAACTTCACCAGCAC |
| ACTGAACAACTCGTGCAAGACCAGTATGGGTCCTATGTCATCCGGCATGTCCTTG |
| AGCACGGACGCCC CGAAGACAAGTCAAAGATCGTGGCTGGAGACGGAGTGT |

TABLE 1-continued module1- hex1 G
GTCATGCGTCTCCAGGTCGATAGTAGCGGTCTCCCGAGGCGAACTTCACCAGCAC

ACTGAACAACTCGTGCAAGACCAGTATGGGTCCTATGTCATCGAACATGTCCTTG

AGCACGGACGCCC CGAAGACAAGTCAAAGATCGTGGCTGGAGACGGAGTGT module1 - hex1 U
GTCATGCGTCTCCAGGTCGATAGTAGCGGTCTCCCGAGGCGAACTTCACCAGCAC

ACTGAACAACTCGTGCAAGACCAGTATGGGAACTATGTCATCCAACATGTCCTTG

AGCACGGACGCC CCGAAGACAAGTCAAAGATCGTGGCTGGAGACGGAGTGT module1 - hex2 A
GTCATGCGTCTCCAGGTCGATAGTAGCGGTCTCCGAACTTCACCAGCACACTGAA

CAACTCGTGCAAGACCAGTATGGGTGCTATGTCATCCAACATGTCCTTGAGCACG

GACGCCCCGAAGA CAAGTCAAAGATCGTGGCTGGAGACGGAGTGT module1 - hex2 C
GTCATGCGTCTCCAGGTCGATAGTAGCGGTCTCCGAACTTCACCAGCACACTGAA

CAACTCGTGCAAGACCAGTATGGGTCCTATGTCATCCGGCATGTCCTTGAGCACG

GACGCCCCGAAGA CAAGTCAAAGATCGTGGCTGGAGACGGAGTGT module1- hex2 G
GTCATGCGTCTCCAGGTCGATAGTAGCGGTCTCCGAACTTCACCAGCACACTGAA

CAACTCGTGCAAGACCAGTATGGGTCCTATGTCATCGAACATGTCCTTGAGCACG

GACGCCCCGAAGA CAAGTCAAAGATCGTGGCTGGAGACGGAGTGT module1 - hex2 U
GTCATGCGTCTCCAGGTCGATAGTAGCGGTCTCCGAACTTCACCAGCACACTGAA

CAACTCGTGCAAGACCAGTATGGGAACTATGTCATCCAACATGTCCTTGAGCACG

GACGCCCCGAAGA CAAGTCAAAGATCGTGGCTGGAGACGGAGTGT module1- hex3 A
GTCATGCGTCTCCAGGTCGATAGTAGCGGTCTCCGGCTGAACTTCACCAGCACAC

TGAACAACTCGTGCAAGACCAGTATGGGTGCTATGTCATCCAACATGTCCTTGAG

CACGGACGCCCCGA AGACAAGTCAAAGATCGTGGCTGGAGACGGAGTGT module1 - hex3 C
GTCATGCGTCTCCAGGTCGATAGTAGCGGTCTCCGGCTGAACTTCACCAGCACAC

TGAACAACTCGTGCAAGACCAGTATGGGTCCTATGTCATCCGGCATGTCCTTGAG

CACGGACGCCCCGA AGACAAGTCAAAGATCGTGGCTGGAGACGGAGTGT module1 - hex3 G
GTCATGCGTCTCCAGGTCGATAGTAGCGGTCTCCGGCTGAACTTCACCAGCACAC

TGAACAACTCGTGCAAGACCAGTATGGGTCCTATGTCATCGAACATGTCCTTGAG

CACGGACGCCCCGA AGACAAGTCAAAGATCGTGGCTGGAGACGGAGTGT module1 - hex3 U
GTCATGCGTCTCCAGGTCGATAGTAGCGGTCTCCGGCTGAACTTCACCAGCACAC

TGAACAACTCGTGCAAGACCAGTATGGGAACTATGTCATCCAACATGTCCTTGAG

CACGGACGCCCCG AAGACAAGTCAAAGATCGTGGCTGGAGACGGAGTGT module1- hex4 A
GTCATGCGTCTCCAGGTCGATAGTAGCGGTCTCCCTGAACTTCACCAGCACACTG

AACAACTCGTGCAAGACCAGTATGGGTGCTATGTCATCCAACATGTCCTTGAGCA

CGGACGCCCCGAA GACAAGTCAAAGATCGTGGCTGGAGACGGAGTGT

TABLE 1-continued module1 - hex4 C
GTCATGCGTCTCCAGGTCGATAGTAGCGGTCTCCCTGAACTTCACCAGCACACTG

AACAACTCGTGCAAGACCAGTATGGGTCCTATGTCATCCGGCATGTCCTTGAGCA

CGGACGCCCCGAA GACAAGTCAAAGATCGTGGCTGGAGACGGAGTGT module1 - hex4 G
GTCATGCGTCTCCAGGTCGATAGTAGCGGTCTCCCTGAACTTCACCAGCACACTG

AACAACTCGTGCAAGACCAGTATGGGTCCTATGTCATCGAACATGTCCTTGAGCA

CGGACGCCCCGAA GACAAGTCAAAGATCGTGGCTGGAGACGGAGTGT module1 - hex4 U
GTCATGCGTCTCCAGGTCGATAGTAGCGGTCTCCCTGAACTTCACCAGCACACTG

AACAACTCGTGCAAGACCAGTATGGGAACTATGTCATCCAACATGTCCTTGAGCA

CGGACGCCCCGAA GACAAGTCAAAGATCGTGGCTGGAGACGGAGTGT module2 A
GTCATGCGTCTCCGGCTGAACTTCACCAGCACACTGAACAACTCGTGCAAGACCA

GTATGGGTGCTATGTCATCCAACATGTCCTTGAGCACGGACGCCCCGAAGACAAG

TCAAAGATCGTG GCTGAGGAGACGGAGTGT module2 C
GTCATGCGTCTCCGGCTGAACTTCACCAGCACACTGAACAACTCGTGCAAGACCA

GTATGGGTCCTATGTCATCCGGCATGTCCTTGAGCACGGACGCCCCGAAGACAAG

TCAAAGATCGTG GCTGAGGAGACGGAGTGT module2 G
GTCATGCGTCTCCGGCTGAACTTCACCAGCACACTGAACAACTCGTGCAAGACCA

GTATGGGTCCTATGTCATCGAACATGTCCTTGAGCACGGACGCCCCGAAGACAAG

TCAAAGATCGTG GCTGAGGAGACGGAGTGT module2 U
GTCATGCGTCTCCGGCTGAACTTCACCAGCACACTGAACAACTCGTGCAAGACCA

GTATGGGAACTATGTCATCCAACATGTCCTTGAGCACGGACGCCCCGAAGACAAG

TCAAAGATCGTG GCTGAGGAGACGGAGTGT module3 A
GTCATGCGTCTCCCTGAACTTCACCAGCACACTGAACAACTCGTGCAAGACCAGT

ATGGGTGCTATGTCATCCAACATGTCCTTGAGCACGGACGCCCCGAAGACAAGTC

AAAGATCGTGGCT GAACGGAGACGGAGTGT module3 C
GTCATGCGTCTCCCTGAACTTCACCAGCACACTGAACAACTCGTGCAAGACCAGT

ATGGGTCCTATGTCATCCGGCATGTCCTTGAGCACGGACGCCCCGAAGACAAGTC

AAAGATCGTGGCT GAACGGAGACGGAGTGT module3 G
GTCATGCGTCTCCCTGAACTTCACCAGCACACTGAACAACTCGTGCAAGACCAGT

ATGGGTCCTATGTCATCGAACATGTCCTTGAGCACGGACGCCCCGAAGACAAGTC

AAAGATCGTGGCT GAACGGAGACGGAGTGT module3 U
GTCATGCGTCTCCCTGAACTTCACCAGCACACTGAACAACTCGTGCAAGACCAGT

ATGGGAACTATGTCATCCAACATGTCCTTGAGCACGGACGCCCCGAAGACAAGTC

AAAGATCGTGGC TGAACGGAGACGGAGTGT

TABLE 1-continued module4 A
GTCATGCGTCTCCGAACTTCACCAGCACACTGAACAACTCGTGCAAGACCAGTAT

GGGTGCTATGTCATCCAACATGTCCTTGAGCACGGACGCCCCGAAGACAAGTCAA

AGATCGTGGGAGA CGGAGTGT module4 C
GTCATGCGTCTCCGAACTTCACCAGCACACTGAACAACTCGTGCAAGACCAGTAT

GGGTCCTATGTCATCCGGCATGTCCTTGAGCACGGACGCCCCGAAGACAAGTCAA

AGATCGTGGGAGA CGGAGTGT module4 G
GTCATGCGTCTCCGAACTTCACCAGCACACTGAACAACTCGTGCAAGACCAGTAT

GGGTCCTATGTCATCGAACATGTCCTTGAGCACGGACGCCCCGAAGACAAGTCAA

AGATCGTGGGAGA CGGAGTGT module4 U
GTCATGCGTCTCCGAACTTCACCAGCACACTGAACAACTCGTGCAAGACCAGTAT

GGGAACTATGTCATCCAACATGTCCTTGAGCACGGACGCCCCGAAGACAAGTCAA

AGATCGTGGGAG ACGGAGTGT module5 A
GTCATGCGTCTCCCGTGGCTGAACTTCACCAGCACACTGAACAACTCGTGCAAGA

CCAGTATGGGTGCTATGTCATCCAACATGTCCTTGAGCACGGACGCCCCGAAGAC

AAGTCAAAGATCG TGGCGGAGACGGAGTGT module5 C
GTCATGCGTCTCCCGTGGCTGAACTTCACCAGCACACTGAACAACTCGTGCAAGA

CCAGTATGGGTCCTATGTCATCCGGCATGTCCTTGAGCACGGACGCCCCGAAGAC

AAGTCAAAGATCG TGGCGGAGACGGAGTGT module5 G
GTCATGCGTCTCCCGTGGCTGAACTTCACCAGCACACTGAACAACTCGTGCAAGA

CCAGTATGGGTCCTATGTCATCGAACATGTCCTTGAGCACGGACGCCCCGAAGAC

AAGTCAAAGATCG TGGCGGAGACGGAGTGT module5 U
GTCATGCGTCTCCCGTGGCTGAACTTCACCAGCACACTGAACAACTCGTGCAAGA

CCAGTATGGGAACTATGTCATCCAACATGTCCTTGAGCACGGACGCCCCGAAGAC

AAGTCAAAGATCG TGGCGGAGACGGAGTGT module6- hex1 A
GTCATGCGTCTCCTGGCTGAACTTCACCAGCACACTGAACAACTCGTGCAAGACC

AGTATGGGTGCTATGTCATCCAACATGTCCTTGAGCACGGACGCCCCGAAGACAA

GTCAAAGATCGTGGCTGAACAGAGACCGGATGGCAGAAGGTGGAGACGGAGTGT module6- hex1 C
GTCATGCGTCTCCTGGCTGAACTTCACCAGCACACTGAACAACTCGTGCAAGACC

AGTATGGGTCCTATGTCATCCGGCATGTCCTTGAGCACGGACGCCCCGAAGACAA

GTCAAAGATCGTGGCTGAACAGAGACCGGATGGCAGAAGGTGGAGACGGAGTGT module6- hex1 G
GTCATGCGTCTCCTGGCTGAACTTCACCAGCACACTGAACAACTCGTGCAAGACC

AGTATGGGTCCTATGTCATCGAACATGTCCTTGAGCACGGACGCCCCGAAGACAA

GTCAAAGATCGTGGCTGAACAGAGACCGGATGGCAGAAGGTGGAGACGGAGTGT

TABLE 1-continued module6- hex1 U
GTCATGCGTCTCCTGGCTGAACTTCACCAGCACACTGAACAACTCGTGCAAGACC

AGTATGGGAACTATGTCATCCAACATGTCCTTGAGCACGGACGCCCCGAAGACAA

GTCAAAGATCGTGGCTGAACAGAGACCGGATGGCAGAAGGTGGAGACGGAGTGT module6- hex2 A
GTCATGCGTCTCCTGGCTGAACTTCACCAGCACACTGAACAACTCGTGCAAGACC

AGTATGGGTGCTATGTCATCCAACATGTCCTTGAGCACGGACGCCCCGAAGACAA

GTCAAAGATCGTG GCTAGAGACCGGATGGCAGAAGGTGGAGACGGAGTGT module6- hex2 C
GTCATGCGTCTCCTGGCTGAACTTCACCAGCACACTGAACAACTCGTGCAAGACC

AGTATGGGTCCTATGTCATCCGGCATGTCCTTGAGCACGGACGCCCCGAAGACAA

GTCAAAGATCGTG GCTAGAGACCGGATGGCAGAAGGTGGAGACGGAGTGT module6- hex2 G
GTCATGCGTCTCCTGGCTGAACTTCACCAGCACACTGAACAACTCGTGCAAGACC

AGTATGGGTCCTATGTCATCGAACATGTCCTTGAGCACGGACGCCCCGAAGACAA

GTCAAAGATCGTG GCTAGAGACCGGATGGCAGAAGGTGGAGACGGAGTGT module6- hex2 U
GTCATGCGTCTCCTGGCTGAACTTCACCAGCACACTGAACAACTCGTGCAAGACC

AGTATGGGAACTATGTCATCCAACATGTCCTTGAGCACGGACGCCCCGAAGACAA

GTCAAAGATCGTG GCTAGAGACCGGATGGCAGAAGGTGGAGACGGAGTGT module6- hex3 A
GTCATGCGTCTCCTGGCTGAACTTCACCAGCACACTGAACAACTCGTGCAAGACC

AGTATGGGTGCTATGTCATCCAACATGTCCTTGAGCACGGACGCCCCGAAGACAA

GTCAAAGATCGTG GCTGAAGAGACCGGATGGCAGAAGGTGGAGACGGAGTGT module6- hex3 C
GTCATGCGTCTCCTGGCTGAACTTCACCAGCACACTGAACAACTCGTGCAAGACC

AGTATGGGTCCTATGTCATCCGGCATGTCCTTGAGCACGGACGCCCCGAAGACAA

GTCAAAGATCGTG GCTGAAGAGACCGGATGGCAGAAGGTGGAGACGGAGTGT module6- hex3 G
GTCATGCGTCTCCTGGCTGAACTTCACCAGCACACTGAACAACTCGTGCAAGACC

AGTATGGGTCCTATGTCATCGAACATGTCCTTGAGCACGGACGCCCCGAAGACAA

GTCAAAGATCGTG GCTGAAGAGACCGGATGGCAGAAGGTGGAGACGGAGTGT module6- hex3 U
GTCATGCGTCTCCTGGCTGAACTTCACCAGCACACTGAACAACTCGTGCAAGACC

AGTATGGGAACTATGTCATCCAACATGTCCTTGAGCACGGACGCCCCGAAGACAA

GTCAAAGATCGTG GCTGAAGAGACCGGATGGCAGAAGGTGGAGACGGAGTGT module6- hex4 A
GTCATGCGTCTCCTGGCTGAACTTCACCAGCACACTGAACAACTCGTGCAAGACC

AGTATGGGTGCTATGTCATCCAACATGTCCTTGAGCACGGACGCCCCGAAGACAA

GTCAAAGATCGTGGCTGGACGCAGAGACCGGATGGCAGAAGGTGGAGACGGAGT

GT

TABLE 1-continued

| |
|---|
| module6- hex4 C<br>GTCATGCGTCTCCTGGCTGAACTTCACCAGCACACTGAACAACTCGTGCAAGACC<br><br>AGTATGGGTCCTATGTCATCCGGCATGTCCTTGAGCACGGACGCCCCGAAGACAA<br><br>GTCAAAGATCGTGGCTGGACGCAGAGACCGGATGGCAGAAGGTGGAGACGGAGT<br><br>GT |
| module6- hex4 G<br>GTCATGCGTCTCCTGGCTGAACTTCACCAGCACACTGAACAACTCGTGCAAGACC<br><br>AGTATGGGTCCTATGTCATCGAACATGTCCTTGAGCACGGACGCCCCGAAGACAA<br><br>GTCAAAGATCGTGGCTGGACGCAGAGACCGGATGGCAGAAGGTGGAGACGGAGT<br><br>GT |
| module6- hex4 U<br>GTCATGCGTCTCCTGGCTGAACTTCACCAGCACACTGAACAACTCGTGCAAGACC<br><br>AGTATGGGAACTATGTCATCCAACATGTCCTTGAGCACGGACGCCCCGAAGACAA<br><br>GTCAAAGATCGTGGCTGGACGCAGAGACCGGATGGCAGAAGGTGGAGACGGAGT<br><br>GT |

As used herein, the term "purification marker" can refer to at least one marker useful for purification or identification. A non-exhaustive list of this marker includes poly-His, lacZ, GST, maltose-binding protein, NusA, BCCP, c-myc, CaM, FLAG, GFP, YFP, cherry, thioredoxin, poly (NANP), V5, Snap, HA, chitin-binding protein, Softag 1, Softag 3, Strep, or S-protein. Suitable direct or indirect fluorescence marker comprise FLAG, GFP, YFP, RFP, dTomato, cherry, Cy3, Cy 5, Cy 5.5, Cy 7, DNP, AMCA, Biotin, Digoxigenin, Tamra, Texas Red, rhodamine, Alexa fluors, FITC, TRITC or any other fluorescent dye or hapten.

As used herein, the term "recombinant expression system" refers to a genetic construct or constructs for the expression of certain genetic material formed by recombination; the term "construct" in this regard is interchangeable with the term "vector" as defined herein. A recombinant expression system can include one or more constructs such as, for example, an expression system wherein a first domain of a polypeptide is encoded by a first construct and a second domain of the polypeptide is encoded by a second construct such that when both domains are expressed and located to a desired site a function protein is produced. One approach as described herein includes restricting catalytic activity of an ADAR of the disclosure by a split reassembly approach. In such a design, a first domain (such as a recruiting domain) can be catalytically inactive by itself and a second domain can be catalytically inactive by itself but when brought together in a reassembly the two domains together provide catalytic activity. A nucleic acid comprising two domains can be split at any number of locations, such as a location between the two domains. In some cases, a first domain or second domain can be operably linked to an MS2 stem loop, a BoxB stem-loop, a U1A stem-loop, a modified version of any of these, or any combination thereof.

As used herein, the term "recombinant protein" can refer to a polypeptide which is produced by recombinant DNA techniques, wherein generally, DNA encoding the polypeptide is inserted into a suitable expression vector which is in turn used to transform a host cell to produce the heterologous protein (recombinant protein). The recombinant protein can be a wild-type protein wherein the coding sequence for the protein has been cloned and expressed in an organism that normally does not express the protein or under the control of a non-natural promoter. The recombinant protein can be a mutant protein that has been mutated to have a biological activity that is different and/or improved from the parental or wild-type protein.

The term "sample" as used herein, generally refers to any sample of a subject (such as a blood sample or a tissue sample). A sample or portion thereof can comprise a stem cell. A portion of a sample can be enriched for the stem cell. The stem cell can be isolated from the sample. A sample can comprise a tissue, a cell, serum, plasma, exosomes, a bodily fluid, or any combination thereof. A bodily fluid can comprise urine, blood, serum, plasma, saliva, mucus, spinal fluid, tears, semen, bile, amniotic fluid, or any combination thereof. A sample or portion thereof can comprise an extracellular fluid obtained from a subject. A sample or portion thereof can comprise cell-free nucleic acid, DNA or RNA. A sample or portion thereof can be analyzed for a presence or absence or one or more mutations. Genomic data can be obtained from the sample or portion thereof. A sample can be a sample suspected or confirmed of having a disease or condition. A sample can be a sample removed from a subject via a non-invasive technique, a minimally invasive technique, or an invasive technique. A sample or portion thereof can be obtained by a tissue brushing, a swabbing, a tissue biopsy, an excised tissue, a fine needle aspirate, a tissue washing, a cytology specimen, a surgical excision, or any combination thereof. A sample or portion thereof can comprise tissues or cells from a tissue type. For example, a sample can comprise a nasal tissue, a trachea tissue, a lung tissue, a pharynx tissue, a larynx tissue, a bronchus tissue, a pleura tissue, an alveoli tissue, breast tissue, bladder tissue, kidney tissue, liver tissue, colon tissue, thyroid tissue, cervical tissue, prostate tissue, heart tissue, muscle tissue, pancreas tissue, anal tissue, bile duct tissue, a bone tissue, brain tissue, spinal tissue, kidney tissue, uterine tissue, ovarian tissue, endometrial tissue, vaginal tissue, vulvar tissue, uterine tissue, stomach tissue, ocular tissue, sinus tissue, penile tissue, salivary gland tissue, gut tissue, gallbladder tissue, gastrointestinal tissue, bladder tissue, brain tissue, spinal tissue, a blood sample, or any combination thereof.

The term "sequencing" as used herein, can comprise bisulfite-free sequencing, bisulfite sequencing, TET-assisted bisulfite (TAB) sequencing, ACE-sequencing, high-throughput sequencing, Maxam-Gilbert sequencing, massively parallel signature sequencing, Polony sequencing, 454 pyrosequencing, Sanger sequencing, Illumina sequencing, SOLiD sequencing, Ion Torrent semiconductor sequencing, DNA nanoball sequencing, Heliscope single molecule sequencing, single molecule real time (SMRT) sequencing, nanopore sequencing, shot gun sequencing, RNA sequencing, Enigma sequencing, or any combination thereof.

As used herein a "split-ADAR" or "split-ADAR system" are used interchangeably and refer to (i) a fragment of the catalytic domain of an ADAR that on its own is biological inactive; (ii) a first fragment of a catalytic domain of an ADAR that on its own is biological inactive and a second fragment of a catalytic domain of an ADAR that on its own is biological inactive; (iii) a tether or anchor moiety operably linked to (i) and (ii) directly of via a linker, wherein when (i), (ii) or (iii) are colocalized and interact a function catalytic domain of ADAR is obtained.

The term "stop codon" intends a three nucleotide contiguous sequence within messenger RNA that signals a termination of translation. Non-limiting examples in RNA include: UAG, UAA, UGA; and in DNA: TAG, TAA or TGA. Unless otherwise noted, the term also includes nonsense mutations within DNA or RNA that introduce a premature stop codon, causing any resulting protein to be abnormally shortened. tRNA that correspond to the various stop codons are known by specific names: amber (UAG), ochre (UAA), and opal (UGA).

The term "subject," "host," "individual," and "patient" are as used interchangeably herein to refer to animals, typically mammalian animals. Any suitable mammal can be treated by a method or composition described herein. Non-limiting examples of mammals include humans, non-human primates (e.g., apes, gibbons, chimpanzees, orangutans, monkeys, macaques, and the like), domestic animals (e.g., dogs and cats), farm animals (e.g., horses, cows, goats, sheep, and pigs) and experimental animals (e.g., mouse, rat, rabbit, and guinea pig). In some embodiments a mammal is a human. A mammal can be any age or at any stage of development (e.g., an adult, teen, child, infant, or a mammal in utero). A mammal can be male or female. A mammal can be a pregnant female. In some embodiments a subject is a human. In some embodiments, a subject has or is suspected of having a cancer or neoplastic disorder. In other embodiments, a subject has or is suspected of having a disease or disorder associated with aberrant protein expression.

"TAR" or "tet/TAR" refers to a non-bacteriophage adapter pair from the bovine immunodeficiency virus (BIV). A 15-17 amino acids sequence (SEQ ID NO:27) from the BIV Tat protein are necessary to bind the TAR element GGCUCGUGUAGCUCAUUAGCU CCGAGCC (SEQ ID NO:28).

"Transfer ribonucleic acid" or "tRNA" is a nucleic acid molecule that helps translate mRNA to protein. tRNA have a distinctive folded structure, comprising three hairpin loops; one of these loops comprises a "stem" portion that encodes an anticodon. The anticodon recognizes the corresponding codon on the mRNA. Each tRNA is "charged with" an amino acid corresponding to the mRNA codon; this "charging" is accomplished by the enzyme tRNA synthetase. Upon tRNA recognition of the codon corresponding to its anticodon, the tRNA transfers the amino acid with which it is charged to the growing amino acid chain to form a polypeptide or protein. Endogenous tRNA can be charged by endogenous tRNA synthetase. Accordingly, endogenous tRNA are typically charged with canonical amino acids. Orthogonal tRNA, derived from an external source, require a corresponding orthogonal tRNA synthetase. Such orthogonal tRNAs may be charged with both canonical and noncanonical amino acids. In some embodiments, the amino acid with which the tRNA is charged may be detectably labeled to enable detection in vivo. Techniques for labeling can include, but are not limited to, click chemistry wherein an azide/alkyne containing unnatural amino acid is added by the orthogonal tRNA/synthetase pair and, thus, can be detected using alkyne/azide comprising fluorophore or other such molecule.

As used herein, the terms "treating," "treatment" and the like are used herein to mean obtaining a desired pharmacologic and/or physiologic effect. The effect can be prophylactic in terms of completely or partially preventing a disease, disorder, or condition or sign or symptom thereof, and/or can be therapeutic in terms of a partial or complete cure for a disorder and/or adverse effect attributable to the disorder.

As used herein, the term "vector" can refer to a nucleic acid construct designed for transfer between different hosts, including but not limited to a plasmid, a virus, a cosmid, a phage, a BAC, a YAC, etc. A "viral vector" is defined as a recombinantly produced virus or viral particle that comprises a polynucleotide to be delivered into a host cell, either in vivo, ex vivo or in vitro. In some embodiments, plasmid vectors can be prepared from commercially available vectors. In other embodiments, viral vectors can be produced from baculoviruses, retroviruses, adenoviruses, AAVs, etc. Examples of viral vectors include retroviral vectors, adenovirus vectors, adeno-associated virus vectors, alphavirus vectors and the like. In one embodiment, the viral vector is a lentiviral vector. Infectious tobacco mosaic virus (TMV)-based vectors can be used to manufacturer proteins and have been reported to express in tobacco leaves (O'Keefe et al. (2009) Proc. Nat. Acad. Sci. USA 106(15):6099-6104). Alphavirus vectors, such as Semliki Forest virus-based vectors and Sindbis virus-based vectors, have also been developed for use in gene therapy and immunotherapy. See, Schlesinger & Dubensky (1999) Curr. Opin. Biotechnol. 5:434-439 and Ying et al. (1999) Nat. Med. 5(7):823-827. In aspects where gene transfer is mediated by a retroviral vector, a vector construct can refer to the polynucleotide comprising the retroviral genome or part thereof, and a gene of interest. Further details as to modern methods of vectors for use in gene transfer can be found in, for example, Kotterman et al. (2015) Viral Vectors for Gene Therapy: Translational and Clinical Outlook Annual Review of Biomedical Engineering 17. A vector can contain both a promoter and a cloning site into which a polynucleotide can be operatively linked. Such vectors are capable of transcribing RNA in vitro or in vivo and are commercially available from sources such as Agilent Technologies (Santa Clara, Calif) and Promega Biotech (Madison, Wis.). In one aspect, the promoter is a pol III promoter.

A viral vector can be an adeno-associated virus (AAV) vector. An AAV can be a recombinant AAV. An AAV can comprise an AAV1 serotype, an AAV2 serotype, an AAV3 serotype, an AAV4 serotype, an AAV5 serotype, an AAV6 serotype, an AAV7 serotype, an AAV8 serotype, an AAV9 serotype, a derivative of any of these, or any combination thereof. An AAV can be selected from the group consisting of: an AAV1 serotype, an AAV2 serotype, an AAV3 serotype, an AAV4 serotype, an AAV5 serotype, an AAV6 serotype, an AAV7 serotype, an AAV8 serotype, an AAV9 serotype, a derivative of any of these, and any combination thereof. A viral vector can be a modified viral vector. A viral vector can be modified to include a modified protein. In some cases, a viral vector can comprise a modified VP1 protein.

Adenosine deaminases may be repurposed for site-specific RNA editing by recruiting them to target RNA sequences using engineered ADAR-recruiting RNAs (adRNAs). Genetically encodable and chemically modified RNA-guided adenosine deaminases have potential for therapeutic applications based on correction of point mutations and the repair of premature stop codons both in vitro and in vivo. However, relying on exogenous ADARs may introduce a significant number of transcriptome wide off-target A-to-I edits. One solution to this problem, disclosed herein, is the engineering of adRNAs to enable the recruitment of endogenous ADARs. In this regard, simple long antisense RNA comprising an RNA targeting domain with a given amount of complementarity to a target RNA as described herein can suffice to recruit endogenous ADARs and these adRNAs are both genetically encodable and chemically synthesizable; and using engineered chemically synthesized antisense oligonucleotides can also lead to robust RNA editing via endogenous ADAR recruitment. Although this modality allows for highly specific editing, its applicability may be limited to editing adenosines in certain RNA motifs preferred by the native ADARs, and in tissues with high endogenous ADAR activity. Additionally, it cannot be utilized for novel functionalities such as deamination of cytosine to uracil (C-to-U) editing which requires exogenous delivery of ADAR2 variants. Thus, engineering a genetically encodable RNA-editing tool that efficiently edits RNA with high specificity and activity is essential for enabling broader use of this toolset for biotechnology and therapeutic applications.

In this regard, the crystal structure of the ADAR2 deaminase domain (ADAR2-DD) and several pioneering biochemical and computational studies have laid the foundation for understanding its catalytic mechanism and target preferences, but a comprehensive knowledge of how mutations and fragmentation affect the ability of the ADAR2-DD to edit RNA is still lacking. To address this, the disclosure provides a quantitative deep mutational scan (DMS) of the ADAR2-DD, measuring the effect of every possible point mutation on enzyme function. The sequence-function map generated from this research, was used to identify novel enhanced variants for A-to-I editing. Additionally, combining information from these sequence-function maps with existing knowledge of the structure and residue conservation scores, a genetically encodable split-ADAR2 system was engineered that enabled efficient and highly specific RNA editing.

The deep mutational scan assayed all possible single amino acid substitutions of 261 residues of the deaminase domain for their impact on RNA editing yields. This sequence-function map complements structure and biochemistry-based studies and improves the understanding of the enzyme, and serves as a map for engineering novel variants with tailored activity for specific applications. The screening chassis was used to also expand deaminase functionality by performing a domain-wide mutagenesis screen to identify variants that increased activity at 5'-GA-3' motifs, and through this analysis variants that enabled robust RNA editing are provided.

The disclosure provides polypeptide and/or polynucleotide sequences for use in gene and protein editing techniques. It should be understood, although not always explicitly stated that the sequences provided herein can be used to provide the expression product as well as substantially identical sequences that produce a protein that has the same biological properties. Specific polypeptide sequences are provided as examples of particular embodiments. Modifications to the sequences to amino acids with alternate amino acids that have similar charge. Additionally, an equivalent polynucleotide is one that hybridizes under stringent conditions to the reference polynucleotide or its complement or in reference to a polypeptide, a polypeptide encoded by a polynucleotide that hybridizes to the reference encoding polynucleotide under stringent conditions or its complementary strand. Alternatively, an equivalent polypeptide or protein is one that is expressed from an equivalent polynucleotide.

The disclosure provides N496$X_2$ or an E488$X_1$/N496$X_2$ double mutants in ADAR2, wherein $X_1$ is Q, H, R, K, N, A, M, S, F, L, or W and $X_2$ is F or Y. In one embodiment, the disclosure provides an N496F or an E488Q/N496F double mutants in ADAR2.

The disclosure provides a recombinant polypeptide having a sequence selected from the group consisting of: (i) a sequence that is at least 85%, 87%, 90%, 92%, 95%, 98%, or 99% identical to SEQ ID NO:2 and having a E488$X_1$ mutation and a N496$X_2$ mutation, wherein $X_1$ is Q, H, R, K, N, A, M, S, F, L, or W and $X_2$ is F or Y and wherein the polypeptide can perform a chemical modification on RNA to convert one base to another (e.g., A→I); (ii) a sequence of SEQ ID NO:2 and having a E488$X_1$ mutation and a N496$X_2$ mutation, wherein $X_1$ is Q, H, R, K, N, A, M, S, F, L, or W and $X_2$ is F or Y and wherein the polypeptide can perform a chemical modification on RNA to convert one base to another (e.g., A→I); (iii) a sequence that is at least 85%, 87%, 90%, 92%, 95%, 98%, or 99% identical SEQ ID NO:2 from amino acid 370-697 and having a E488$X_1$ mutation and a N496$X_2$ mutation, wherein $X_1$ is Q, H, R, K, N, A, M, S, F, L, or W and $X_2$ is F or Y and wherein the polypeptide can perform a chemical modification on RNA to convert one base to another (e.g., A→I); and (iv) a sequence of SEQ ID NO:2 from amino acid 370-697 and having a E488$X_1$ mutation and a N496$X_2$ mutation, wherein $X_1$ is Q, H, R, K, N, A, M, S, F, L, or W and $X_2$ is F or Y and wherein the polypeptide can perform a chemical modification on RNA to convert one base to another (e.g., A→I).

The disclosure further provides recombinant ADAR polypeptide having a sequence selected from SEQ ID NO:29-62 and 63 or catalytically active fragments thereof (e.g., comprising amino acids 316-701) and sequence that are at least 85, 90, 92, 95, 97, 98, or 99% identical thereto.

The disclosure provides mutant ADAR1 E1008$X_1$ or S1016$X_2$ or an E1008$X_1$/S1016$X_2$ double mutants in ADAR1, wherein $X_1$ is Q, H, R, K, N, A, M, S, F, L, or W and $X_2$ is F or Y. In one embodiment, the disclosure provides an E1008Q or an S1016F double mutants in ADAR1.

The disclosure also provides a recombinant polypeptide having a sequence selected from the group consisting of: (i) a sequence that is at least 85%, 87%, 90%, 92%, 95%, 98%, or 99% identical to SEQ ID NO:4 and having a E1008$X_1$ mutation and a S1016$X_2$ mutation, wherein $X_1$ is Q, H, R, K, N, A, M, S, F, L, or W and $X_2$ is F or Y and wherein the polypeptide can perform a chemical modification on RNA to convert one base to another (e.g., A→I); (ii) a sequence of SEQ ID NO:4 and having a E1008$X_1$ mutation and a S1016$X_2$ mutation, wherein $X_1$ is Q, H, R, K, N, A, M, S, F, L, or W and $X_2$ is F or Y and wherein the polypeptide can perform a chemical modification on RNA to convert one base to another (e.g., A→I); (iii) a sequence that is at least 85%, 87%, 90%, 92%, 95%, 98%, or 99% identical SEQ ID NO:2 from amino acid 886-1221 and having a E1008$X_1$ mutation and a S1016$X_2$ mutation, wherein $X_1$ is Q, H, R, K, N, A, M, S, F, L, or W and $X_2$ is F or Y and wherein the polypeptide can perform a chemical modification on RNA to convert one base to another (e.g., A→I); and (iv) a sequence of SEQ ID NO:2 from amino acid 886-1221 and having a E1008$X_1$ mutation and a S1016$X_2$ mutation, wherein $X_1$ is Q, H, R, K, N, A, M, S, F, L, or W and $X_2$ is F or Y and wherein the polypeptide can perform a chemical modification on RNA to convert one base to another (e.g., A→I).

The disclosure further provides recombinant ADAR polypeptide having a sequence selected from SEQ ID NO:64-97 and 98 or catalytically active fragments thereof (e.g., comprising amino acids 886-1221) and sequence that are at least 85, 90, 92, 95, 97, 98, or 99% identical thereto.

The disclosure shows that an ADAR2-DD (N496F, E488Q) double mutant was 1.5-2.5 fold more efficient at editing adenosines with a 5' guanosine than the classic hyperactive ADAR2-DD (E488Q). In some embodiments, an isolated polypeptide as described herein (e.g. an ADAR2 polypeptide) can have a single mutation relative to a wild-type polypeptide, such as a mutation at position 488 of SEQ ID NO: 2 or a mutation at position 496 of SEQ ID NO: 2. In some embodiments, an isolated polypeptide as described herein (e.g. an ADAR2 polypeptide) can have a plurality of mutations relative to a wildtype polypeptide, such as a mutation at position 488 of SEQ ID NO: 2 and a mutation at position 496 of SEQ ID NO: 2.

In some embodiments, in addition to an N496X mutation, the adenosine deaminase may comprise one or more of the mutations selected from G336D, G487A, G487V, E488Q, E488H, E488R, E488N, E488A, E488S, E488M, T490C, T490S, V493T, V493S, V493A, V493R, V493D, V493P, V493G, N597K, N597R, N597A, N597E, N597H, N597G, N597Y, A589V, S599T, N613K, N613R, N613A, N613E of SEQ ID NO:2. In some embodiments, an ADAR of the disclosure comprises mutation at N496 and one or more additional positions selected from E488, R348, V351, T375, K376, E396, C451, R455, N473, R474, K475, R477, R481, S486, T490, S495, R510.

In some embodiments, the recombinant ADARs of the disclosure recognize and convert one or more target adenosine residue(s) in a double-stranded nucleic acid substrate into inosine residues (s). In some embodiments, the double-stranded nucleic acid substrate is a RNA-DNA hybrid duplex. In some embodiments, the adenosine deaminase protein recognizes a binding window on the double-stranded substrate. In some embodiments, the binding window contains at least one target adenosine residue(s). In some embodiments, the binding window is in the range of about 3 bp to about 100 bp. In some embodiments, the binding window is in the range of about 5 bp to about 50 bp. In some embodiments, the binding window is in the range of about 10 bp to about 30 bp. In some embodiments, the binding window is about 1 bp, 2 bp, 3 bp, 5 bp, 7 bp, 10 bp, 15 bp, 20 bp, 25 bp, 30 bp, 40 bp, 45 bp, 50 bp, 55 bp, 60 bp, 65 bp, 70 bp, 75 bp, 80 bp, 85 bp, 90 bp, 95 bp, or 100 bp.

As mentioned above, overexpression of ADARs can lead to several transcriptome wide off-target edits. The ability to restrict the catalytic activity of the ADAR2 DD only to the target mRNA can reduce the number of off-targets. Creation of a split-ADAR2 DD reduces the number of off-targets. Split-protein reassembly or protein fragment complementation can be a widely used approach to study protein-protein interactions. Splitting the ADAR2 DD can be designed in such a way that each fragment of the split-ADAR2 DD can be catalytically inactive by itself. However, in the presence of the adRNA, the split halves can dimerize to form a catalytically active enzyme at the intended mRNA target.

The deaminase domain of ADAR2 was further analyzed at the fragment level to create split deaminases each of which was inactive by itself but together formed a functional enzyme upon combining at the target site. Accordingly, the disclosure provides split ADARs, wherein one domain of a split ADAR comprises SEQ ID NO:2 from amino acid 316 to about 465 (e.g., 465, 466, 467, or 468) operably linked to a first adapter of an adapter pair (directly or via a linker) and a second domain of a split ADAR comprising SEQ ID NO:2 from about amino acid 466 (e.g., 466, 467, 468, or 469) to the C-terminus (e.g., 701) of SEQ ID NO: 2. Table A provides exemplary split ADAR constructs of the disclosure:

TABLE A

T1 is a tether moiety other than MS2 selected from the group consisting of tet, PUF, Cas protein, PP7, Qβ, F2, GA, fr, JP501, M12, R17, BZ13, JP34, JP500, KU1, M11, MX1, TW18, VK, SP, FI, ID2, NL95, TW19, AP205, φCb5, φCb8r, φCb12r, φCb23r, 7s and PRR1; and
T2 is a tether moiety other than λN selected from the group consisting of tet, PUF, Cas protein, PP7, Qβ, F2, GA, fr, JP501, M12, R17, BZ13, JP34, JP500, KU1, M11, MX1, TW18, VK, SP, FI, ID2, NL95, TW19, AP205, φCb5, φCb8r, φCb12r, φCb23r, 7s and PRR1, wherein T1 and T2 are not the same in the split ADAR pair:

| Split ADAR | ADAR domain sequence | Adapter/tether |
|---|---|---|
| 1 | 85-100% identical to SEQ ID NO: 2 from aa 316-465 | MS2 coat protein or T1 |
| 2 | 85-100% identical to SEQ ID NO: 2 from aa 466-701 | λN (1-4 copies) or T2 |
| 3 | 85-100% identical to SEQ ID NO: 2 from aa 316-465 | λN (1-4 copies) or T2 |
| 4 | 85-100% identical to SEQ ID NO: 2 from aa 466-701 | MS2 coat protein or T1 |
| 5 | 85-100% identical to SEQ ID NO: 2 from aa 316-466 | MS2 coat protein or T1 |
| 6 | 85-100% identical to SEQ ID NO: 2 from aa 467-701 | λN (1-4 copies) or T2 |
| 7 | 85-100% identical to SEQ ID NO: 2 from aa 316-466 | λN (1-4 copies) or T2 |
| 8 | 85-100% identical to SEQ ID NO: 2 from aa 467-701 | MS2 coat protein or T1 |
| 9 | 85-100% identical to SEQ ID NO: 2 from aa 316-467 | MS2 coat protein or T1 |
| 10 | 85-100% identical to SEQ ID NO: 2 from aa 468-701 | λN (1-4 copies) or T2 |
| 11 | 85-100% identical to SEQ ID NO: 2 from aa 316-467 | λN (1-4 copies) or T2 |
| 12 | 85-100% identical to SEQ ID NO: 2 from aa 468-701 | MS2 coat protein or T1 |
| 13 | 85-100% identical to SEQ ID NO: 2 from aa 316-468 | MS2 coat protein or T1 |

TABLE A-continued

T1 is a tether moiety other than MS2 selected from the group consisting of tet, PUF, Cas protein, PP7, Qβ, F2, GA, fr, JP501, M12, R17, BZ13, JP34, JP500, KU1, M11, MX1, TW18, VK, SP, FI, ID2, NL95, TW19, AP205, φCb5, φCb8r, φCb12r, φCb23r, 7s and PRR1; and
T2 is a tether moiety other than λN selected from the group consisting of tet, PUF, Cas protein, PP7, Qβ, F2, GA, fr, JP501, M12, R17, BZ13, JP34, JP500, KU1, M11, MX1, TW18, VK, SP, FI, ID2, NL95, TW19, AP205, φCb5, φCb8r, φCb12r, φCb23r, 7s and PRR1, wherein T1 and T2 are not the same in the split ADAR pair:

| Split ADAR | ADAR domain sequence | Adapter/tether |
|---|---|---|
| 14 | 85-100% identical to SEQ ID NO: 2 from aa 469-701 | λN (1-4 copies) or T2 |
| 15 | 85-100% identical to SEQ ID NO: 2 from aa 316-468 | λN (1-4 copies) or T2 |
| 16 | 85-100% identical to SEQ ID NO: 2 from aa 469-701 | MS2 coat protein or T1 |

In the split ADAR constructs 1-16 in Table A, each of pairs (e.g., 1 and 2; 3 and 4 etc.) are recruited to the site of editing by an adRNA comprising an RNA sequence having the general structure (BoxB)-(targeting RNA)-(MS2-targeted stem loop) or (MS2-targeted stem loop)-(targeting RNA)-(BoxB). The targeting RNA can be any sequence that can hybridize to an RNA having a nucleotide to be modified. The flanking BoxB and MS2 targeted step loop domains are described above (e.g., SEQ ID NO:13, 14, 23 and 24).

In one embodiment, a split ADAR polypeptide of the disclosure comprises a first domain comprising SEQ ID NO:8 or sequence that are at least 85% identical to SEQ ID NO:8 and a second domain comprising SEQ ID NO:10 or sequences that are at least 85% identical to SEQ ID NO:10.

In one embodiment, a split ADAR polypeptide of the disclosure comprises SEQ ID NO:10 or sequence that are at least 85% identical to SEQ ID NO:10. In another embodiment, a split ADAR polypeptide of the disclosure comprise SEQ ID NO: 10 having a E21$X_1$ mutation and a N29$X_2$ mutation, wherein $X_1$ is Q, H, R, K, N, A, M, S, F, L, or W and $X_2$ is F or Y.

In yet another embodiment, an ADAR domain of a split ADAR construct can be linked to an adaptor/tether domain via a linker. Various linkers are selected such that they do not interfere with the function of each domain that is linked by the linker. Accordingly, a recombinant split-ADAR of the disclosure can comprise a (first ADAR domain)-(linker)-(anchor/tether domain).

The split-ADAR2 of the disclosure was transcript specific (>1000 fold compared to full domain over expression), and with off-target profiles similar to those seen via recruitment of endogenous ADARs. This split-ADAR2 tool paves the way for the use of the highly active ADAR2 deaminase domain variants discovered by deep mutational scans and provide for an enabling broader utility of the ADAR toolset for biotechnology and therapeutic applications. Additionally, these approaches could also be applied to the study and engineering of other RNA modifying enzymes.

Further completely humanized versions of these constructs can be created by harnessing human RNA binding proteins and adapter/tethering systems, such as (a) U1A or (b) its evolved variant TBP6.7 which has no known endogenous human hairpin targets or (c) the human histone stem loop binding protein (SLBP) or (d) the DNA binding domain of glucocorticoid receptor, or (e) any combination thereof. These proteins can be fused to the N and C terminal fragments of the ADAR2 to create a completely human and programmable RNA editing toolset that can edit adenosines with exquisite specificity. Further, chimeric RNA (adRNA) bearing two of the corresponding RNA hairpins can be utilized to recruit the ADAR2 fragments. Sequences of various RNA hairpins are provided herein.

The disclosure also provide polynucleotides encoding recombinant polypeptide, fusion constructs and/or adRNAs of the disclosure.

In one embodiment, the disclosure provides a polynucleotide encoding a polypeptide having a sequence selected from the group consisting of: (i) a sequence that is at least 85%, 87%, 90%, 92%, 95%, 98%, or 99% identical to SEQ ID NO:2 and having a E488$X_1$ mutation and a N496$X_2$ mutation, wherein $X_1$ is Q, H, R, K, N, A, M, S, F, L, or W and $X_2$ is F or Y and wherein the polypeptide can perform a chemical modification on RNA to convert one base to another (e.g., A→I); (ii) a sequence of SEQ ID NO:2 and having a E488$X_1$ mutation and a N496$X_2$ mutation, wherein $X_1$ is Q, H, R, K, N, A, M, S, F, L, or W and $X_2$ is F or Y and wherein the polypeptide can perform a chemical modification on RNA to convert one base to another (e.g., A→I); (iii) a sequence that is at least 85%, 87%, 90%, 92%, 95%, 98%, or 99% identical SEQ ID NO:2 from amino acid 370-697 and having a E488$X_1$ mutation and a N496$X_2$ mutation, wherein $X_1$ is Q, H, R, K, N, A, M, S, F, L, or W and $X_2$ is F or Y and wherein the polypeptide can perform a chemical modification on RNA to convert one base to another (e.g., A→I); and (iv) a sequence of SEQ ID NO:2 from amino acid 370-697 and having a E488$X_1$ mutation and a N496$X_2$ mutation, wherein $X_1$ is Q, H, R, K, N, A, M, S, F, L, or W and $X_2$ is F or Y and wherein the polypeptide can perform a chemical modification on RNA to convert one base to another (e.g., A→I).

In another embodiment, the disclosure provides a polynucleotide that hybridizes to a sequence consisting of SEQ ID NO:1 under highly stringent or moderately stringent condition and encodes a polypeptide having a sequence selected from the group consisting of: (i) a sequence that is at least 85%, 87%, 90%, 92%, 95%, 98%, or 99% identical to SEQ ID NO:2 and having a E488$X_1$ mutation and a N496$X_2$ mutation, wherein $X_1$ is Q, H, R, K, N, A, M, S, F, L, or W and $X_2$ is F or Y and wherein the polypeptide can perform a chemical modification on RNA to convert one base to another (e.g., A→I); (ii) a sequence of SEQ ID NO:2 and having a E488$X_1$ mutation and a N496$X_2$ mutation, wherein $X_1$ is Q, H, R, K, N, A, M, S, F, L, or W and $X_2$ is F or Y and wherein the polypeptide can perform a chemical modification on RNA to convert one base to another (e.g., A→I); (iii) a sequence that is at least 85%, 87%, 90%, 92%, 95%, 98%, or 99% identical SEQ ID NO:2 from amino acid 370-697 and having a E488$X_1$ mutation and a N496$X_2$ mutation, wherein $X_1$ is Q, H, R, K, N, A, M, S, F, L, or W and $X_2$ is F or Y and wherein the polypeptide can perform a chemical modification on RNA to convert one base to another (e.g., A→I); and (iv) a sequence of SEQ ID NO:2 from amino acid 370-697 and having a E488$X_1$ mutation and a N496$X_2$ mutation, wherein $X_1$ is Q, H, R, K, N, A, M, S, F, L, or W and $X_2$ is F or Y and wherein the polypeptide can perform a chemical modification on RNA to convert one base to another (e.g., A→I).

In yet another embodiment, the disclosure provides a polynucleotide encoding a polypeptide having a sequence selected from the group consisting of: (i) a sequence that is at least 85%, 87%, 90%, 92%, 95%, 98%, or 99% identical to SEQ ID NO:4 and having a E1008$X_1$ mutation and a S1016$X_2$ mutation, wherein $X_1$ is Q, H, R, K, N, A, M, S, F, L, or W and $X_2$ is F or Y and wherein the polypeptide can perform a chemical modification on RNA to convert one base to another (e.g., A→I); (ii) a sequence of SEQ ID NO:4 and having a E1008$X_1$ mutation and a S1016$X_2$ mutation, wherein $X_1$ is Q, H, R, K, N, A, M, S, F, L, or W and $X_2$ is F or Y and wherein the polypeptide can perform a chemical modification on RNA to convert one base to another (e.g., A→I); (iii) a sequence that is at least 85%, 87%, 90%, 92%, 95%, 98%, or 99% identical SEQ ID NO:4 from amino acid 886-1221 and having a E1008$X_1$ mutation and a S1016$X_2$ mutation, wherein $X_1$ is Q, H, R, K, N, A, M, S, F, L, or W and $X_2$ is F or Y and wherein the polypeptide can perform a chemical modification on RNA to convert one base to another (e.g., A→I); and (iv) a sequence of SEQ ID NO:4 from amino acid 886-1221 and having a E1008$X_1$ mutation and a S1016$X_2$ mutation, wherein $X_1$ is Q, H, R, K, N, A, M, S, F, L, or W and $X_2$ is F or Y and wherein the polypeptide can perform a chemical modification on RNA to convert one base to another (e.g., A→I).

In another embodiment, the disclosure provides a polynucleotide that hybridizes to a sequence consisting of SEQ ID NO:3 under highly stringent or moderately stringent condition and encodes a polypeptide having a sequence selected from the group consisting of: (i) a sequence that is at least 85%, 87%, 90%, 92%, 95%, 98%, or 99% identical to SEQ ID NO:4 and having a E1008$X_1$ mutation and a S1016$X_2$ mutation, wherein $X_1$ is Q, H, R, K, N, A, M, S, F, L, or W and $X_2$ is F or Y and wherein the polypeptide can perform a chemical modification on RNA to convert one base to another (e.g., A→I); (ii) a sequence of SEQ ID NO:4 and having a E1008$X_1$ mutation and a S1016$X_2$ mutation, wherein $X_1$ is Q, H, R, K, N, A, M, S, F, L, or W and $X_2$ is F or Y and wherein the polypeptide can perform a chemical modification on RNA to convert one base to another (e.g., A→I); (iii) a sequence that is at least 85%, 87%, 90%, 92%, 95%, 98%, or 99% identical SEQ ID NO:4 from amino acid 886-1221 and having a E1008$X_1$ mutation and a S1016$X_2$ mutation, wherein $X_1$ is Q, H, R, K, N, A, M, S, F, L, or W and $X_2$ is F or Y and wherein the polypeptide can perform a chemical modification on RNA to convert one base to another (e.g., A→I); and (iv) a sequence of SEQ ID NO:4 from amino acid 886-1221 and having a E1008$X_1$ mutation and a S1016$X_2$ mutation, wherein $X_1$ is Q, H, R, K, N, A, M, S, F, L, or W and $X_2$ is F or Y and wherein the polypeptide can perform a chemical modification on RNA to convert one base to another (e.g., A→I).

In yet another embodiment, the disclosure provides a polynucleotide encoding a polypeptide comprising SEQ ID NO:8 or sequence that are at least 85% identical to SEQ ID NO:8.

In another embodiment, the disclosure provides a polynucleotide that hybridizes to a sequence consisting of SEQ ID NO:7 under highly stringent or moderately stringent condition and encodes a polypeptide having a sequence of SEQ ID NO:8 or sequence that are at least 85% identical to SEQ ID NO:8.

In yet another embodiment, the disclosure provides a polynucleotide encoding a polypeptide comprising SEQ ID NO:10 or sequences that are at least 85% identical to SEQ ID NO:10.

In another embodiment, the disclosure provides a polynucleotide that hybridizes to a sequence consisting of SEQ ID NO:9 under highly stringent or moderately stringent condition and encodes a polypeptide having a sequence of SEQ ID NO:10 or sequence that are at least 85% identical to SEQ ID NO:10.

In still another embodiment, the disclosure provides a polynucleotide that encodes a polypeptide comprising SEQ ID NO:10 having a E21$X_1$ mutation and a N29$X_2$ mutation, wherein $X_1$ is Q, H, R, K, N, A, M, S, F, L, or W and $X_2$ is F or Y. In another embodiment, the disclosure provides a polynucleotide that hybridizes to a sequence consisting of SEQ ID NO:9 under highly stringent or moderately stringent condition and encodes a polypeptide comprising SEQ ID NO:10 having a E21$X_1$ mutation and a N29$X_2$ mutation, wherein $X_1$ is Q, H, R, K, N, A, M, S, F, L, or W and $X_2$ is F or Y.

A polynucleotide of the disclosure can comprise more than one coding sequence wherein each coding domain are operably linked such that upon expression a multi-domain polypeptide is generated. In some instances, domains of the polynucleotide may be separated by a coding sequence for a peptide linker.

A vector can be employed to deliver a polynucleotide encoding an adRNA and/or a recombinant ADAR or split-ADAR of the disclosure. A vector can comprise DNA, such as double stranded DNA or single stranded DNA. A vector can comprise RNA. In some cases, the RNA can comprise a base modification. The vector can comprise a recombinant vector. The vector can be a vector that is modified from a naturally occurring vector. The vector can comprise at least a portion of a non-naturally occurring vector. As used herein, the terms "non-naturally occurring" and "engineered" are used interchangeably to refer to the polynucleotides of the disclosure. Any vector can be utilized. In some cases, the vector can comprise a viral vector, a liposome, a nanoparticle, an exosome, an extracellular vesicle, or any combination thereof. In some cases, a viral vector can comprise an adenoviral vector, an adeno-associated viral vector (AAV), a lentiviral vector, a retroviral vector, a portion of any of these, or any combination thereof. In some cases, a nanoparticle vector can comprise a polymeric-based nanoparticle, an aminolipid based nanoparticle, a metallic nanoparticle (such as gold-based nanoparticle), a portion of any of these, or any combination thereof. In some cases, a vector can comprise an AAV vector. A vector can be modified to include a modified VP1 protein (such as an AAV vector modified to include a VP1 protein). An AAV can comprise a serotype—such as an AAV1 serotype, an AAV2 serotype, AAV3 serotype, an AAV4 serotype, AAV5 serotype, an AAV6 serotype, AAV7 serotype, an AAV8 serotype, an AAV9 serotype, a derivative of any of these, or any combination thereof.

The pharmaceutical compositions for the administration of a split-ADAR, recombinant ADAR and/or AdRNA can be conveniently presented in dosage unit form. The pharmaceutical compositions can be, for example, prepared by uniformly and intimately bringing the compounds provided herein into association with a liquid carrier, a finely divided solid carrier or both, and then, if necessary, shaping the product into the desired formulation. In the pharmaceutical composition the compound provided herein is included in an amount sufficient to produce the desired therapeutic effect. For example, pharmaceutical compositions of the technology can take a form suitable for virtually any mode of administration, including, for example, topical, ocular, oral, buccal, systemic, nasal, injection, infusion, transdermal, rectal, and vaginal, or a form suitable for administration by inhalation or insufflation.

Systemic formulations include those designed for administration by injection (e.g., subcutaneous, intravenous, infusion, intramuscular, intrathecal, or intraperitoneal injection) as well as those designed for transdermal, transmucosal, oral, or pulmonary administration.

Useful injectable preparations include sterile suspensions, solutions, or emulsions of the compounds provided herein in aqueous or oily vehicles. The compositions can also contain formulating agents, such as suspending, stabilizing, and/or dispersing agents. The formulations for injection can be presented in unit dosage form, e.g., in ampules or in multidose containers, and can contain added preservatives.

Alternatively, the injectable formulation can be provided in powder form for reconstitution with a suitable vehicle, including but not limited to sterile pyrogen free water, buffer, and dextrose solution, before use. To this end, the compounds provided herein can be dried using techniques, such as lyophilization, and reconstituted prior to use.

For transmucosal administration, penetrants appropriate to the barrier to be permeated are used in the formulation.

For oral administration, the pharmaceutical compositions can take the form of, for example, lozenges, tablets, or capsules prepared by conventional means with pharmaceutically acceptable excipients such as binding agents (e.g., pregelatinised maize starch, polyvinylpyrrolidone, or hydroxypropyl methylcellulose); fillers (e.g., lactose, microcrystalline cellulose, or calcium hydrogen phosphate); lubricants (e.g., magnesium stearate, talc, or silica); disintegrants (e.g., potato starch or sodium starch glycolate); or wetting agents (e.g., sodium lauryl sulfate). The tablets can be coated by methods including, for example, sugars, films, or enteric coatings.

Compositions intended for oral use can be prepared for the manufacture of pharmaceutical compositions, and such compositions can contain one or more agents selected from the group consisting of sweetening agents, flavoring agents, coloring agents, and preserving agents in order to provide pharmaceutically elegant and palatable preparations. Tablets contain the compounds provided herein in admixture with non-toxic pharmaceutically acceptable excipients which are suitable for the manufacture of tablets. These excipients can be for example, inert diluents, such as calcium carbonate, sodium carbonate, lactose, calcium phosphate or sodium phosphate; granulating and disintegrating agents (e.g., corn starch or alginic acid); binding agents (e.g. starch, gelatin, or acacia); and lubricating agents (e.g., magnesium stearate, stearic acid, or talc). The tablets can be left uncoated or they can be coated by known techniques to delay disintegration and absorption in the gastrointestinal tract and thereby provide a sustained action over a longer period. For example, a time delay material such as glyceryl monostearate or glyceryl distearate can be employed. The pharmaceutical compositions of the technology can also be in the form of oil-in-water emulsions.

Liquid preparations for oral administration can take the form of, for example, elixirs, solutions, syrups, or suspensions, or they can be presented as a dry product for constitution with water or other suitable vehicle before use. Such liquid preparations can be prepared by conventional means with pharmaceutically acceptable additives such as suspending agents (e.g., sorbitol syrup, cellulose derivatives, or hydrogenated edible fats); emulsifying agents (e.g., lecithin, or acacia); non-aqueous vehicles (e.g., almond oil, oily esters, ethyl alcohol, Cremophore™, or fractionated vegetable oils); and preservatives (e.g., methyl or propyl-p-hydroxybenzoates or sorbic acid). The preparations can also contain buffer salts, preservatives, flavoring, coloring, and sweetening agents as appropriate.

"Administration" can be effected in one dose, continuously or intermittently throughout the course of treatment. Single or multiple administrations can be carried out with the dose level and pattern being selected by the treating physician. Route of administration can also be determined and can vary with the composition used for treatment, the purpose of the treatment, the health condition or disease stage of the subject being treated, and target cell or tissue. Non-limiting examples of route of administration include oral administration, nasal administration, injection, and topical application.

Administration can refer to methods that can be used to enable delivery of compounds or compositions (such a DNA constructs, viral vectors, or others) to the desired site of biological action. These methods can include topical administration (such as a lotion, a cream, an ointment) to an external surface of a surface, such as a skin. These methods can include parenteral administration (including intravenous, subcutaneous, intrathecal, intraperitoneal, intramuscular, intravascular or infusion), oral administration, inhalation administration, intraduodenal administration, rectal administration. In some instances, a subject can administer the composition in the absence of supervision. In some instances, a subject can administer the composition under the supervision of a medical professional (e.g., a physician, nurse, physician's assistant, orderly, hospice worker, etc.). In some cases, a medical professional can administer the composition. In some cases, a cosmetic professional can administer the composition.

Administration or application of a composition disclosed herein can be performed for a treatment duration of at least about at least about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 days consecutive or nonconsecutive days. In some cases, a treatment duration can be from about 1 to about 30 days, from about 2 to about 30 days, from about 3 to about 30 days, from about 4 to about 30 days, from about 5 to about 30 days, from about 6 to about 30 days, from about 7 to about 30 days, from about 8 to about 30 days, from about 9 to about 30 days, from about 10 to about 30 days, from about 11 to about 30 days, from about 12 to about 30 days, from about 13 to about 30 days, from about 14 to about 30 days, from about 15 to about 30 days, from about 16 to about 30 days, from about 17 to about 30 days, from about 18 to about 30 days, from about 19 to about 30 days, from about 20 to about 30 days, from about 21 to about 30 days, from about 22 to about 30 days, from about 23 to about 30 days, from about 24 to about 30 days, from about 25 to about 30 days, from about 26 to about 30 days, from about 27 to about 30 days, from about 28 to about 30 days, or from about 29 to about 30 days.

Administration or application of composition disclosed herein can be performed at least 1, 2, 3, 4, 5, 6, 7, 8, 9, 10, 11, 12, 13, 14, 15, 16, 17, 18, 19, 20, 21, 22, 23, or 24 times a day. In some cases, administration or application of composition disclosed herein can be performed at least 1, 2, 3, 4, 5, 6, 7, 8, 9, 10, 11, 12, 13, 14, 15, 16, 17, 18, 19, 20, or 21 times a week. In some cases, administration or application of composition disclosed herein can be performed at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, or 90 times a month.

In some cases, a composition can be administered/applied as a single dose or as divided doses. In some cases, the compositions described herein can be administered at a first time point and a second time point. In some cases, a composition can be administered such that a first administration is administered before the other with a difference in administration time of 1 hour, 2 hours, 4 hours, 8 hours, 12 hours, 16 hours, 20 hours, 1 day, 2 days, 4 days, 7 days, 2 weeks, 4 weeks, 2 months, 3 months, 4 months, 5 months, 6 months, 7 months, 8 months, 9 months, 10 months, 11 months, 1 year or more.

In the case of an in vitro application, in some embodiments the effective amount can depend on the size and nature of the application in question. It can also depend on the nature and sensitivity of the in vitro target and the methods in use. The effective amount can comprise one or more administrations of a composition depending on the embodiment.

A "composition" typically intends a combination of agents, e.g., a recombinant ADAR, split-ADAR and/or an adRNA of this disclosure, along with a compound or composition, and a naturally-occurring or non-naturally-occurring carrier, inert (for example, a detectable agent or label) or active, such as an adjuvant, diluent, binder, stabilizer, buffers, salts, lipophilic solvents, preservative, adjuvant or the like and include pharmaceutically acceptable carriers. Carriers also include pharmaceutical excipients and additives proteins, peptides, amino acids, lipids, and carbohydrates (e.g., sugars, including monosaccharides, di-, tri-, tetra-oligosaccharides, and oligosaccharides; derivatized sugars such as alditols, aldonic acids, esterified sugars and the like; and polysaccharides or sugar polymers), which can be present singly or in combination, comprising alone or in combination 1-99.99% by weight or volume. Exemplary protein excipients include serum albumin such as human serum albumin (HSA), recombinant human albumin (rHA), gelatin, casein, and the like. Representative amino acid/antibody components, which can also function in a buffering capacity, include alanine, arginine, glycine, arginine, betaine, histidine, glutamic acid, aspartic acid, cysteine, lysine, leucine, isoleucine, valine, methionine, phenylalanine, aspartame, and the like. Carbohydrate excipients are also intended within the scope of this technology, examples of which include but are not limited to monosaccharides such as fructose, maltose, galactose, glucose, D-mannose, sorbose, and the like; disaccharides, such as lactose, sucrose, trehalose, cellobiose, and the like; polysaccharides, such as raffinose, melezitose, maltodextrins, dextrans, starches, and the like; and alditols, such as mannitol, xylitol, maltitol, lactitol, xylitol sorbitol (glucitol) and myoinositol.

A composition described herein can compromise an excipient. An excipient can be added to a stem cell or can be co-isolated with the stem cell from its source. An excipient can comprise a cryo-preservative, such as DMSO, glycerol, polyvinylpyrrolidone (PVP), or any combination thereof. An excipient can comprise a cryo-preservative, such as a sucrose, a trehalose, a starch, a salt of any of these, a derivative of any of these, or any combination thereof. An excipient can comprise a pH agent (to minimize oxidation or degradation of a component of the composition), a stabilizing agent (to prevent modification or degradation of a component of the composition), a buffering agent (to enhance temperature stability), a solubilizing agent (to increase protein solubility), or any combination thereof. An excipient can comprise a surfactant, a sugar, an amino acid, an antioxidant, a salt, a non-ionic surfactant, a solubilizer, a triglyceride, an alcohol, or any combination thereof. An excipient can comprise sodium carbonate, acetate, citrate, phosphate, poly-ethylene glycol (PEG), human serum albumin (HSA), sorbitol, sucrose, trehalose, polysorbate 80, sodium phosphate, sucrose, disodium phosphate, mannitol, polysorbate 20, histidine, citrate, albumin, sodium hydroxide, glycine, sodium citrate, trehalose, arginine, sodium acetate, acetate, HCl, disodium edetate, lecithin, glycerine, xanthan rubber, soy isoflavones, polysorbate 80, ethyl alcohol, water, teprenone, or any combination thereof. An excipient can be an excipient described in the Handbook of Pharmaceutical Excipients, American Pharmaceutical Association (1986).

Non-limiting examples of suitable excipients can include a buffering agent, a preservative, a stabilizer, a binder, a compaction agent, a lubricant, a chelator, a dispersion enhancer, a disintegration agent, a flavoring agent, a sweetener, a coloring agent.

In some cases, an excipient can be a buffering agent. Non-limiting examples of suitable buffering agents can include sodium citrate, magnesium carbonate, magnesium bicarbonate, calcium carbonate, and calcium bicarbonate. As a buffering agent, sodium bicarbonate, potassium bicarbonate, magnesium hydroxide, magnesium lactate, magnesium glucomate, aluminium hydroxide, sodium citrate, sodium tartrate, sodium acetate, sodium carbonate, sodium polyphosphate, potassium polyphosphate, sodium pyrophosphate, potassium pyrophosphate, disodium hydrogen phosphate, dipotassium hydrogen phosphate, trisodium phosphate, tripotassium phosphate, potassium metaphosphate, magnesium oxide, magnesium hydroxide, magnesium carbonate, magnesium silicate, calcium acetate, calcium glycerophosphate, calcium chloride, calcium hydroxide and other calcium salts or combinations thereof can be used in a pharmaceutical formulation.

In some cases, an excipient can comprise a preservative. Non-limiting examples of suitable preservatives can include antioxidants, such as alpha-tocopherol and ascorbate, and antimicrobials, such as parabens, chlorobutanol, and phenol. Antioxidants can further include but not limited to EDTA, citric acid, ascorbic acid, butylated hydroxytoluene (BHT), butylated hydroxy anisole (BHA), sodium sulfite, p-amino benzoic acid, glutathione, propyl gallate, cysteine, methionine, ethanol and N-acetyl cysteine. In some instances a preservatives can include validamycin A, TL-3, sodium ortho vanadate, sodium fluoride, N-a-tosyl-Phe-chloromethylketone, N-a-tosyl-Lys-chloromethylketone, aprotinin, phenylmethylsulfonyl fluoride, diisopropylfluorophosphate, kinase inhibitor, phosphatase inhibitor, caspase inhibitor, granzyme inhibitor, cell adhesion inhibitor, cell division inhibitor, cell cycle inhibitor, lipid signaling inhibitor, protease inhibitor, reducing agent, alkylating agent, antimicrobial agent, oxidase inhibitor, or other inhibitor.

In some cases, a pharmaceutical formulation can comprise a binder as an excipient. Non-limiting examples of suitable binders can include starches, pregelatinized starches, gelatin, polyvinylpyrolidone, cellulose, methylcellulose, sodium carboxymethylcellulose, ethylcellulose, polyacrylamides, polyvinyloxoazolidone, polyvinylalcohols, C12-C18 fatty acid alcohol, polyethylene glycol, polyols, saccharides, oligosaccharides, and combinations thereof.

The binders that can be used in a pharmaceutical formulation can be selected from starches such as potato starch, corn starch, wheat starch; sugars such as sucrose, glucose, dextrose, lactose, maltodextrin; natural and synthetic gums; gelatine; cellulose derivatives such as microcrystalline cellulose, hydroxypropyl cellulose, hydroxyethyl cellulose, hydroxypropyl methyl cellulose, carboxymethyl cellulose, methyl cellulose, ethyl cellulose; polyvinylpyrrolidone (povidone); polyethylene glycol (PEG); waxes; calcium carbonate; calcium phosphate; alcohols such as sorbitol, xylitol, mannitol, water or a combination thereof.

In some cases, a pharmaceutical formulation can comprise a lubricant as an excipient. Non-limiting examples of suitable lubricants can include magnesium stearate, calcium stearate, zinc stearate, hydrogenated vegetable oils, sterotex, polyoxyethylene monostearate, talc, polyethyleneglycol, sodium benzoate, sodium lauryl sulfate, magnesium lauryl sulfate, and light mineral oil. The lubricants that can be used in a pharmaceutical formulation can be selected from metallic stearates (such as magnesium stearate, calcium stearate, aluminium stearate), fatty acid esters (such as sodium stearyl fumarate), fatty acids (such as stearic acid), fatty alcohols, glyceryl behenate, mineral oil, paraffins, hydrogenated vegetable oils, leucine, polyethylene glycols (PEG), metallic lauryl sulphates (such as sodium lauryl sulphate, magnesium lauryl sulphate), sodium chloride, sodium benzoate, sodium acetate and talc or a combination thereof.

In some cases, a pharmaceutical formulation can comprise a dispersion enhancer as an excipient. Non-limiting examples of suitable dispersants can include starch, alginic acid, polyvinylpyrrolidones, guar gum, kaolin, bentonite, purified wood cellulose, sodium starch glycolate, isoamorphous silicate, and microcrystalline cellulose as high HLB emulsifier surfactants.

In some cases, a pharmaceutical formulation can comprise a disintegrant as an excipient. In some cases, a disintegrant can be a non-effervescent disintegrant. Non-limiting examples of suitable non-effervescent disintegrants can include starches such as corn starch, potato starch, pregelatinized and modified starches thereof, sweeteners, clays, such as bentonite, micro-crystalline cellulose, alginates, sodium starch glycolate, gums such as agar, guar, locust bean, karaya, pecitin, and tragacanth. In some cases, a disintegrant can be an effervescent disintegrant. Non-limiting examples of suitable effervescent disintegrants can include sodium bicarbonate in combination with citric acid, and sodium bicarbonate in combination with tartaric acid.

In some cases, an excipient can comprise a flavoring agent. Flavoring agents incorporated into an outer layer can be chosen from synthetic flavor oils and flavoring aromatics; natural oils; extracts from plants, leaves, flowers, and fruits; and combinations thereof. In some cases, an excipient can comprise a sweetener. Non-limiting examples of suitable sweeteners can include glucose (corn syrup), dextrose, invert sugar, fructose, and mixtures thereof (when not used as a carrier); saccharin and its various salts such as a sodium salt; dipeptide sweeteners such as aspartame; dihydrochalcone compounds, glycyrrhizin; *Stevia Rebaudiana* (Stevioside); chloro derivatives of sucrose such as sucralose; and sugar alcohols such as sorbitol, mannitol, sylitol, and the like.

The compositions used in accordance with the disclosure, including cells, treatments, therapies, agents, drugs and pharmaceutical formulations can be packaged in dosage unit form for ease of administration and uniformity of dosage. The term "unit dose" or "dosage" can refer to physically discrete units suitable for use in a subject, each unit containing a predetermined quantity of the composition calculated to produce the desired responses in association with its administration, i.e., the appropriate route and regimen. The quantity to be administered, both according to number of treatments and unit dose, depends on the result and/or protection desired. Factors affecting dose include physical and clinical state of the subject, route of administration, intended goal of treatment (alleviation of symptoms versus cure), and potency, stability, and toxicity of the particular composition. Upon formulation, solutions can be administered in a manner compatible with the dosage formulation and in such amount as is therapeutically or prophylactically effective. The formulations are easily administered in a variety of dosage forms, such as the type of injectable solutions described herein.

As used herein, the term "reduce or eliminate expression and/or function of" can refer to reducing or eliminating the transcription of said polynucleotides into mRNA, or alternatively reducing or eliminating the translation of said mRNA into peptides, polypeptides, or proteins, or reducing or eliminating the functioning of said peptides, polypeptides, or proteins. In a non-limiting example, the transcription of polynucleotides into mRNA is reduced to at least half of its normal level found in wild type cells.

The phrase "first line" or "second line" or "third line" can refer to the order of treatment received by a patient. First line therapy regimens are treatments given first, whereas second or third line therapy are given after the first line therapy or after the second line therapy, respectively. The National Cancer Institute defines first line therapy as "the first treatment for a disease or condition. In patients with cancer, primary treatment can be surgery, chemotherapy, radiation therapy, or a combination of these therapies. First line therapy is also referred to as "primary therapy and primary treatment." See National Cancer Institute website at cancer.gov, last visited Nov. 15, 2017. Typically, a patient is given a subsequent chemotherapy regimen because the patient did not show a positive clinical or sub-clinical response to the first line therapy or the first line therapy has stopped.

The term "contacting" means direct or indirect binding or interaction between two or more entities. A particular example of direct interaction is binding. A particular example of an indirect interaction is where one entity acts upon an intermediary molecule, which in turn acts upon the second referenced entity. Contacting as used herein includes in solution, in solid phase, in vitro, ex vivo, in a cell and in vivo. Contacting in vivo can be referred to as administering, or administration.

A disease or condition that can be treated using a mutant ADAR of the disclosure can comprise a neurodegenerative disease, a muscular disorder, a metabolic disorder, an ocular disorder, or any combination thereof. The disease or condition can comprise cystic fibrosis, albinism, alpha-1-antitrypsin deficiency, Alzheimer disease, Amyotrophic lateral sclerosis, Asthma, β-thalassemia, Cadasil syndrome, Charcot-Marie-Tooth disease, Chronic Obstructive Pulmonary Disease (COPD), Distal Spinal Muscular Atrophy (DSMA), Duchenne/Becker muscular dystrophy, Dystrophic Epidermolysis bullosa, Epidermylosis bullosa, Fabry disease, Factor V Leiden associated disorders, Familial Adenomatous, Polyposis, Galactosemia, Gaucher's Disease, Glucose-6-phosphate dehydrogenase, Haemophilia, Hereditary Hematochromatosis, Hunter Syndrome, Huntington's disease, Hurler Syndrome, Inflammatory Bowel Disease (IBD), Inherited polyagglutination syndrome, Leber congenital amaurosis, Lesch-Nyhan syndrome, Lynch syndrome, Marfan syndrome, Mucopolysaccharidosis, Muscular Dystrophy, Myotonic dystrophy types I and II, neurofibromatosis, Niemann-Pick disease type A, B and C, NY-esol related cancer, Parkinson's disease, Peutz-Jeghers Syndrome, Phenylketonuria, Pompe's disease, Primary Ciliary Disease, Prothrombin mutation related disorders, such as the Prothrombin G20210A mutation, Pulmonary Hypertension, Retinitis Pigmentosa, Sandhoff Disease, Severe Combined Immune Deficiency Syndrome (SCID), Sickle Cell Anemia, Spinal Muscular Atrophy, Stargardt's Disease, Tay-Sachs Disease, Usher syndrome, X-linked immunodeficiency, various forms of cancer (e.g. BRCA1 and 2 linked breast cancer and ovarian cancer). The disease or condition can comprise a muscular dystrophy, an ornithine transcarbamylase deficiency, a retinitis pigmentosa, a breast cancer, an ovarian cancer, Alzheimer's disease, pain, Stargardt macular dystropy, Charcot-Marie-Tooth disease, Rett syndrome, or any combination thereof. Administration of a composition can be sufficient to: (a) decrease expression of a gene relative to an expression of the gene prior to administration; (b) edit at least one point mutation in a subject, such as a subject in need thereof; (c) edit at least one stop codon in the subject to produce a readthrough of a stop codon; (d) produce an exon skip in the subject, or (e) any combination thereof.

The following examples are non-limiting and illustrative of procedures which can be used in various instances in carrying the disclosure into effect. Additionally, all reference disclosed herein are incorporated by reference in their entirety.

EXAMPLES

Oligonucleotide Pools:

To create the library of single amino acid substitutions in the ADAR2 deaminase domain, oligonucleotide chip (CustomArray) consisting of 6 oligonucleotide pools (each 168 bp in length) was ordered. These pools, in combination, spanned residues 340-600 of the ADAR2 deaminase domain. Each of these pools was amplified in a 50 μl PCR reaction using Kapa HiFi HotStart PCR Mix (Kapa Biosystems), 40 ng of synthesized oligonucleotide as template and pool-specific primers. The 6 PCR products were purified using the QIAquick PCR Purification Kit (Qiagen) to eliminate byproducts.

Creation of Vectors for Cloning Oligonucleotide Pools:

A gene block (IDT) for MCP-ADAR2-DD-NES was ordered and mutagenesis PCR was used to create the MCP-ADAR2-DD(E488Q)-NES. These fragments were then used as templates to generate 6 PCR fragments from which deletions of the MCP-ADAR2-DD-NES and the MCP-ADAR2-DD(E488Q)-NES were created. The deleted regions corresponded to the sequence covered by each of the 6 oligonucleotide pools and was replaced instead with an Esp3I digestion site. To create the plasmid library, the two Esp3I digestion sites in the LentiCRISPR v2 plasmid (Addgene #52961) were mutated using PCR mutagenesis followed by Gibson Assembly. Next, 6 cloning vectors were created for the MCP-ADAR2-DD-NES and MCP-ADAR2-DD(E488Q)-NES, cloning the PCR fragments generated above into the LentiCRISPR v2 vector digested with BamHI and XbaI using Gibson Assembly. All PCRs in this section were carried out using Kapa HiFi HotStart PCR Mix (Kapa Biosystems), 20 ng template and appropriate primers in 20 μl reactions. All digestions in this section were carried out in 50 μl reactions for 3 hours at 37° C. using 2 μg of plasmid and 10 units of enzyme(s). All Gibson Assembly reactions in this section were carried out using 50 ng backbone and 30 ng of insert in a 10 μl volume and incubated at 50° C. for 1 hour. Digestions and PCRs were purified using the QIAquick PCR Purification Kit (Qiagen).

Creation of Plasmid Library:

Once 6 cloning vectors corresponding to the MCP-ADAR2-DD-NES ready were obtained, they were digested with Esp3I. These digestions were carried out in 50 μl reactions for 6 hours at 37° C. using 2 μg of plasmid and 10 units of enzyme followed by heat inactivation at 65° C. for 20 minutes. The digestion reaction was then purified using the QIAquick PCR Purification Kit (Qiagen). This was followed by cloning of the 6 oligonucleotide pools into their respective cloning vectors via Gibson Assembly using 50 ng of the digested backbone and 10 ng of the purified oligonucleotide PCR products in a 10 μl reaction, incubated at 50° C. for 80 minutes. The Gibson Assembly reaction was purified by dialysis and used to electroporate ElectroMAX Stbl4 cells (ThermoFisher) as per the manufacturer's instructions. A small fraction (1-10 μl) of cultures was spread on carbenicillin LB plates to calculate the library coverage, and the rest of the cultures were amplified overnight in 150 ml LB medium containing carbenicillin. A library coverage of at least 400x was ensured before proceeding. Plasmid libraries were sequenced using the MiSeq (300 bp PE run).

Creation of MS2-adRNA Vectors:

The Cas9-P2A-Puromycin from the LentiCRISPR v2 was replaced with a mCherry-P2A-Hygromycin by digesting the backbone with XbaI and PmeI. Fusion PCRs was used to create the mCherry-P2A-Hygromycin-WPRE-3'LTR(Delta U3) insert which was then cloned into the digested backbone via Gibson Assembly. PCR was used to create a MS2-adRNA-mU6-MS2-adRNA cassette which was cloned into the Esp3I digested backbone via Gibson Assembly. 4 vectors with 2x MS2-adRNAs were created targeting 5' and 3' TAG and GAC. All PCRs in this section were carried out using Kapa HiFi HotStart PCR Mix (Kapa Biosystems) in 20 μl reactions. All digestions in the section were carried out in 50 μl reactions for 3 hours at 37° C. using 2 μg of plasmid and 10 units of enzymes. All Gibson Assembly reactions in this section were carried out using 50 ng backbone and 20-40 ng of insert in a 10 μl volume and incubated at 50° C. for 1 hour. Digestions and PCRs were purified using the QIAquick PCR Purification Kit (Qiagen).

Lentivirus Production:

HEK293FT cells were maintained in DMEM supplemented with 10% FBS (Thermo Fisher) and 1% Antibiotic-Antimycotic (Thermo Fisher) in an incubator at 37° C. and 5% C02 atmosphere. To produce lentivirus particles, HEK293FT cells were seeded in 15-cm tissue culture dishes 1 day before transfection and were 60% confluent at the time of transfection. Before transfection, the culture medium was changed to prewarmed DMEM supplemented with 10% FBS. For each 15-cm dish, 36 μl of Lipofectamine 2000 (Thermo Fisher) was diluted in 1.2 ml OptiMEM (Thermo Fisher). Separately, 3 μg pMD2.G (gift from Didier Trono, Addgene #12259), 12 μg of pCMV delta R8.2 (gift from Didier Trono, Addgene #12263) and 9 μg of lentiviral vector were diluted in 1.2 ml OptiMEM. After incubation for 5 min, the Lipofectamine 2000 mixture and DNA mixture were combined and incubated at room temperature for 30 minutes. The mixture was then added dropwise to HEK293FT cells. Viral particles were harvested 48 h and 72 h after transfection, further concentrated to a final volume of 500-1000 μl using 100 kDA filters (Millipore), divided into aliquots and frozen at −80° C. Lentivirus was produced individually for all MS2-adRNA vectors and in a pooled format for the libraries. While producing lentivirus, libraries were grouped together as 1+2, 3, 4, 5+6 so as to facilitate sequencing using the NovaSeq 6000 (250 bp PE run).

Creation of a Clonal Cell Line with MS2-adRNA:

HEK293FT cells grown in a 6-well plate were transduced with lentiviruses (high MOI) carrying 2×MS2-adRNA targeting 5' and 3' TAG and GAC to create 4 different cell lines. For transductions, the lentivirus was mixed with DMEM supplemented with 10% FBS (Thermo Fisher) and Polybrene Transfection reagent (Millipore) at a concentration of 5 μg/ml and added to HEK293FT cells at 40-50% confluency. Hygromycin (Thermo Fisher) was added to the media at a concentration of 100 μg/ml, 48 hours post transduction. Top 1% of mCherry expressing cells for each line were then sorted into a 96 well plate. 3 clones of each of the 4 cell lines were then frozen down.

Screen:

Lentiviral libraries 1+2 and 3 were used to transduce clones with the 5' TAG and GAC MS2-adRNA and libraries 4 and 5+6 were used to transduce clones with the 3' TAG and GAC MS2-adRNA stably integrated. Transductions were carried out in duplicates. The lentiviral libraries were mixed with DMEM supplemented with 10% FBS (Thermo Fisher), Hygromycin (Thermo Fisher) at 100 μg/ml, Polybrene Transfection reagent (Millipore) at a concentration of 5 μg/ml and added to the stable clones harboring the MS2-adRNA in a 15 cm dish at 40-50% confluency. To ensure most cells received 0 or 1 ADAR2 variant, cells were transduced at a low MOI of 0.2-0.4. 24 hours post transfections, cells were passaged 1:4 into a new 15 cm dish and grown in DMEM supplemented with 10% FBS (Thermo Fisher) and Hygromycin (Thermo Fisher) at 100 μg/ml. 48 hours post transductions, the growth medium was changed to DMEM supplemented with 10% FBS (Thermo Fisher) and Puromycin (Thermo Fisher) at 3 μg/ml. 72 hours post transduction, fresh growth medium with Puromycin was added to the cells. 96 hours post transductions, the growth media was taken off and cells were washed with PBS and then harvested. Cell pellets were stored at −80° C. until RNA extraction. At least 1000× coverage was maintained at all steps of the screen.

RNA, cDNA, Amplifications, Indexing:

RNA was extracted using the RNeasy mini kit (Qiagen) as per the manufacturer's instructions. cDNA was synthesized from RNA using the Protoscript II First Strand cDNA synthesis Kit (NEB). To ensure library coverage of 500x, 5 ng of RNA was converted to cDNA per library element in every sample of the screen. The volume of each cDNA reaction was 90 μl with 4.5 μg RNA, 45 μl of the Reaction mix, 9 μl Random primers and 9 μl Enzyme. Samples were incubated in a thermocycler at 25° C. for 5 min; 42° C. for 80 min; 80° C. for 5 min. The entire volume of the cDNA reaction was used to set up PCR reactions. The volume of each PCR reaction was 100 μl with 44 μl cDNA, 6 μl primers (10 μM) and 50 μl Q5 high fidelity master mix (NEB). The thermocycling parameters were: 98° C. for 30 s; 24-28 cycles of 98° C. for 10 s, 62° C. for 15 s, and 72° C. for 35 s; and 72° C. for 2 min. The numbers of cycles were tested to ensure that they fell within the linear phase of amplification. The amplicons were 440-570 bp in length and purified using the QIAquick PCR Purification Kit (Qiagen). To continue maintaining at least 500× coverage, at minimum 0.15 ng of the PCR product per library element was used to set up a second PCR adding indices onto the libraries. This was done in 50 μl reactions using 3 μl dual index primers (NEB), 135 ng purified PCR product from the previous reaction and 25 μl Q5 high fidelity master mix (NEB). The thermocycling parameters were: 98° C. for 30 s; 5-8 cycles of 98° C. for 10 s, 65° C. for 20 s, 72° C. for 35 s; and 72° C. for 2 min. The numbers of cycles were tested to ensure that they fell within the linear phase of amplification. Amplicons were purified with Agencourt AMPure XP beads (Beckman Coulter) at a 0.8 ratio. The libraries were quantified using the Qubit dsDNA HS assay kit (Thermo Fisher) and pooled together at a concentration of 10 nM for sequencing on a 250 bp PE run on the NovaSeq 6000.

Sequencing Analysis:

Raw fastq reads were aligned to the ADAR2 reference sequence using minimap2 in short-read mode with default parameters. For libraries with overlapping paired end reads, the reads were first combined using FLASH. The aligned reads were then classified into library members using strict filtering, i.e. reads were only included if they perfectly matched exactly one library member, aside from the target ADAR editing site. The editing rate at this target site was then quantified for each library member and averaged across two replicates with weights for differential coverage. To analyze the degree to which each library member differed in editing rate from the wild-type, a two-proportion Z-test was performed using a pooled sample proportion to calculate the standard error of the sampling distribution, and a two-tailed procedure to calculate p-values. Note that the wild-type rate was restricted to the rate measured within each library, such that each library member was compared only to the wild-type rate measured in the same biological context. Z-scores were calculated as follows, where x is the RNA editing rate, and n is the number of counts:

$$\underline{x} = \frac{x_{wt} n_{wt} + x_i n_i}{n_{wt} + n_i}$$

$$SE = \sqrt{\underline{x}(1 - \underline{x})\left(\left(\frac{1}{n_i}\right) + \left(\frac{1}{n_{wt}}\right)\right)}$$

$$Z_i = \frac{x_i - x_{wt}}{SE}$$

The library classification and editing quantification procedures were carried out using a custom python package, which can be found at https://github.com/natepalmer/deepak. Heatmap plotting was done with modified code from Enrich2 (https://github.com/FowlerLab/Enrich2).

Cloning Individual Mutants:

A cloning vector was created with the MCP inserted into the LentiCRISPR v2 vector digested with BamHI and XbaI using Gibson Assembly. This vector was then digested with BamHI to clone the DD mutants. All mutants were created using mutagenesis PCR followed by Gibson Assembly. All PCRs in this section were carried out using Q5 PCR Mix (NEB), 5 ng template and appropriate primers in 20 μl reactions. All digestions in this section were carried out in 50 μl reactions for 3 hours at 37° C. using 3 μg of plasmid and 20 units of enzyme(s). All Gibson Assembly reactions in this section were carried out using 30 ng backbone and 15 ng of insert in a 6 μl volume and incubated at 50° C. for 1 hour. Digestions and PCRs were purified using the QIAquick PCR Purification Kit (Qiagen).

Luciferase Assay:

All HEK 293FT cells were grown in DMEM supplemented with 10% FBS and 1% Antibiotic-Antimycotic (Thermo Fisher) in an incubator at 37° C. and 5% C02 atmosphere. All in vitro luciferase experiments for DMS validations were carried out in HEK 293FT cells seeded in 96 well plates, at 25-30% confluency, using 250 ng total plasmid and 0.5 μl of commercial transfection reagent Lipofectamine 2000 (Thermo Fisher). Specifically, every well received 100 ng of the Cluc-W85X(TAG) or Cluc-W85X(TGA) reporters, 50 ng of MCP-ADAR2-DD mutants and 100 ng of the MS2-adRNA plasmids. In cases where less than 3 plasmids were needed, a balancing plasmid was added to keep the total amount per well as 250 ng. 48 hours post transfections, 20 μl of supernatant from cells was added to a Costar black 96 well plate (Corning). For the readout, 50 μl of Cypridina Assay buffer was mixed with 0.5 μl Vargulin substrate (Thermo Fisher) respectively and added to the 96 well plate in the dark. The luminescence was read within 10 minutes on Spectramax i3× or iD3 plate readers (Molecular Devices) with the following settings: 5 s mix before read, 5 s integration time, 1 mm read height.

RNA Editing:

RNA editing experiments for targeting 5'-GA-3' were carried out in HEK 293FT cells seeded in 24 well plates using 1000 ng total plasmid and 2 ul of commercial transfection reagent Lipofectamine 2000 (Thermo Fisher). Specifically, every well received 500 ng each MCP-ADAR2-DD fragments and the adRNA plasmids. Cells were transfected at 25-30% confluence and harvested 48 hours post transfection for quantification of editing. RNA from cells was extracted using the RNeasy Mini Kit (Qiagen). cDNA was synthesized from 500 ng RNA using the Protoscript II First Strand cDNA synthesis Kit (NEB). 1 ul of cDNA was amplified by PCR with primers that amplify about 200 bp surrounding the sites of interest using OneTaq PCR Mix (NEB). The numbers of cycles were tested to ensure that they fell within the linear phase of amplification. PCR products were purified using a PCR Purification Kit (Qiagen) and sent out for Sanger sequencing. The RNA editing efficiency was quantified using the ratio of peak heights G/(A+G).

Split-ADAR2. Vector Design and Construction:

pAAV_hU6_mU6_CMV_GFP was digested with AflII to clone the NES-FLAG-MCP-linker and linker-4xλN-HA-NES downstream of the CMV promoter which were amplified from the MCP-ADAR2-DD-NLS and 4x-λN-cdADAR2 respectively. AvrII digestion sites were included downstream of the NES-FLAG-MCP-linker and upstream of the linker-4xλN-HA-NES to facilitate cloning of the split fragments. All split fragments were amplified from the MCP-ADAR2-DD-NLS or MCP-ADAR2-DD(E488Q)-NLS. For each split-ADAR2 pair, the N-terminal DD fragment was cloned downstream of the NES-FLAG-MCP-linker and the C-terminal DD fragment was cloned upstream of the linker-4xλN-HA-NES using Gibson Assembly. MS2-MS2, MS2-BoxB, BoxB-MS2 and BoxB-BoxB adRNA were created by annealing primers and cloned downstream of the hU6 promoter into the AgeI+NheI digested pAAV_hU6_mU6_CMV_GFP using Gibson Assembly. All PCRs in this section were carried out using Kapa HiFi HotStart PCR Mix (Kapa Biosystems) in 20 μl reactions. All digestions in this section were carried out in 50 μl reactions for 3 hours at 37° C. using 3 μg of plasmid and 20 units of enzyme(s). All Gibson Assembly reactions in this section were carried out using 40 ng backbone and 5-20 ng of insert in a 10 μl volume and incubated at 50° C. for 1 hour. Digestions and PCRs were purified using the QIAquick PCR Purification Kit (Qiagen).

Luciferase Assay:

All HEK 293FT cells were grown in DMEM supplemented with 10% FBS and 1% Antibiotic-Antimycotic (Thermo Fisher) in an incubator at 37° C. and 5% $CO_2$ atmosphere. All in vitro luciferase experiments for the split-ADAR2 were carried out in HEK 293FT cells seeded in 96 well plates, at 25-30% confluency, using 400 ng total plasmid and 0.6 μl of commercial transfection reagent Lipofectamine 2000 (Thermo Fisher). Specifically, every well received 100 ng each of the Cluc-W85X(TAG) reporter, N- and C-terminal ADAR2 fragments and the adRNA plasmids. In cases where less than 4 plasmids were needed, a balancing plasmid was added to keep the total amount per well as 400 ng. 48 hours post transfections, 20 μl of supernatant from cells was added to a Costar black 96 well plate (Corning). For the readout, 50 μl of Cypridina Glow Assay buffer was mixed with 0.5 μl Vargulin substrate (Thermo Fisher) and added to the 96 well plate in the dark. The luminescence was read within 10 minutes on Spectramax i3× or iD3 plate readers (Molecular Devices) with the following settings: 5s mix before read, 5s integration time, 1 mm read height.

RNA Editing:

All in vitro RNA editing experiments were carried out in HEK 293FT cells seeded in 24 well plates using 1500 ng total plasmid and 2 ul of commercial transfection reagent Lipofectamine 2000 (Thermo Fisher). Specifically, every well received 500 ng each of the N- and C-terminal ADAR2 fragments and the adRNA plasmids. In cases where less than 3 plasmids were needed, a balancing plasmid was added to keep the total amount per well as 1500 ng. Cells were transfected at 25-30% confluence and harvested 48 hours post transfection for quantification of editing. RNA from cells was extracted using the RNeasy Mini Kit (Qiagen). cDNA was synthesized from 500 ng RNA using the Protoscript II First Strand cDNA synthesis Kit (NEB). 1 ul of cDNA was amplified by PCR with primers that amplify about 200 bp surrounding the sites of interest using OneTaq PCR Mix (NEB). The numbers of cycles were tested to ensure that they fell within the linear phase of amplification. PCR products were purified using a PCR Purification Kit (Qiagen) and sent out for Sanger sequencing. The RNA editing efficiency was quantified using the ratio of peak heights G/(A+G). RNA-seq libraries were prepared from 250 ng of RNA, using the NEBNext Poly(A) mRNA magnetic isolation module and NEBNext Ultra RNA Library Prep Kit for Illumina. Samples were pooled and loaded on an Illumina Novaseq (100 bp paired-end run) to obtain 40-45 million reads per sample.

Quantification of RNA-Seq A-to-G Editing:

RNA-seq analysis for quantification of transcriptome-wide A-to-G editing was carried (Katrekar et al., In vivo RNA editing of point mutations via RNA-guided adenosine deaminases. Nat Methods 16, 239-242 (2019)).

Deep Mutational Scanning of the ADAR2 Deaminase Domain.

To gain comprehensive insight into how mutations affect the ADAR2 deaminase domain (ADAR2-DD), deep mutational scanning (DMS) was used, a technique that enables simultaneous assessment of the activities of thousands of protein variants. Typically, this approach relies on phenotypic selection methods such as cell fitness or fluorescent reporters that result in an enrichment of beneficial variants and a depletion of deleterious variants. However, as RNA editing yields are not precisely quantifiable using surrogate readouts, the experiments focused on directly measuring enzymatic activity in the screens. To do so, genotype was linked to phenotype by placing the RNA editing site on the same transcript encoding the deaminase variant, and ensuring every cell in the pooled screen received a single library element. This novel approach enabled a quantitative deep mutational scan of the core 261 amino acids (residues 340-600) of the ADAR2-deaminase domain via 4959 (261×19) single amino acid variants, measuring the effect of each mutation on adenosine to inosine (A-to-I) editing yields (FIG. 1A).

Figure 5A:
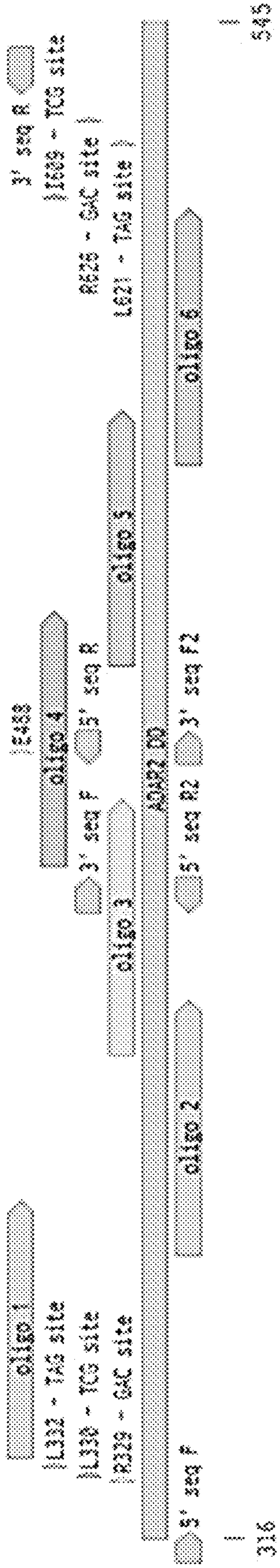
Figure 5B:
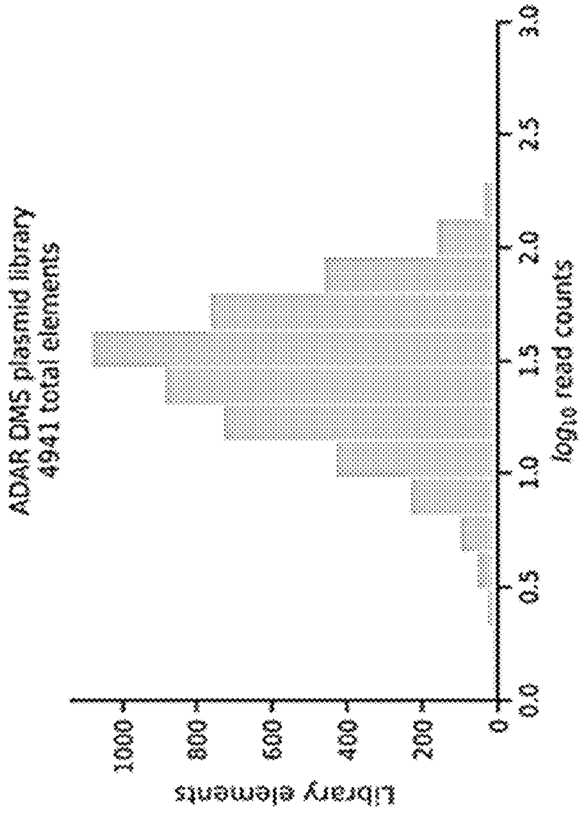
Figure 5C:
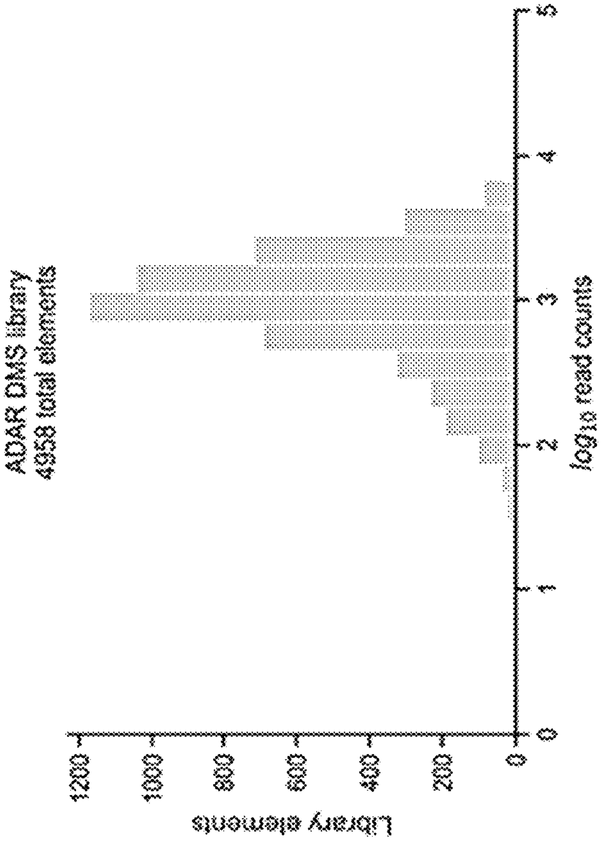
Figure 5D:
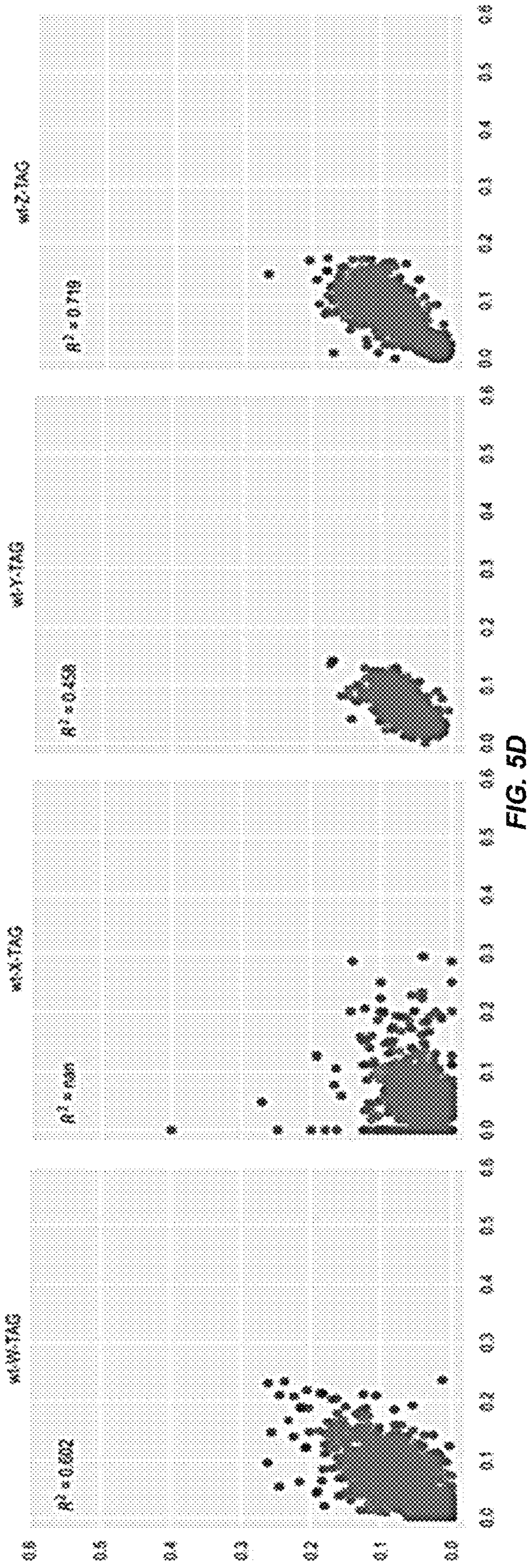

Given the large size of the deaminase domain at >750 bp, the library was created using 6 tiling oligonucleotide pools (FIG. 5A). These pools were cloned into a lentiviral vector containing the MS2 coat protein (MCP) and the remainder of the deaminase domain and a puromycin resistance gene (FIG. 1A, FIG. 5B). Editing sites were chosen within the deaminase domain, outside of the mutated residues, such that an A-to-I change would result in a synonymous mutation. To ensure read length coverage in next generation sequencing, members of the first three library pools were assayed for editing at the 5' end while the remaining members were assayed at the 3' end of the deaminase domain (FIG. 5A). Towards this, two HEK293FT clonal cell lines were created with MS2-adRNAs targeting 5' and 3' UAG sites integrated into them. The scan was carried out in cell lines harboring these MS2-adRNAs by transducing them with the corresponding libraries at a low MOI (0.2-0.4). Following lentiviral transduction and puromycin selection, RNA was extracted from the harvested cells and reverse transcribed. Relevant regions of the deaminase domain were amplified from the cDNA and sequenced (FIG. 5C). 4958 of the 4959 possible variants were successfully detected. The deaminase domain transcripts for each variant also contained the associated A-to-I editing yields, which were then quantified for both replicates of the DMS (FIG. 5D).

Figure 1B:
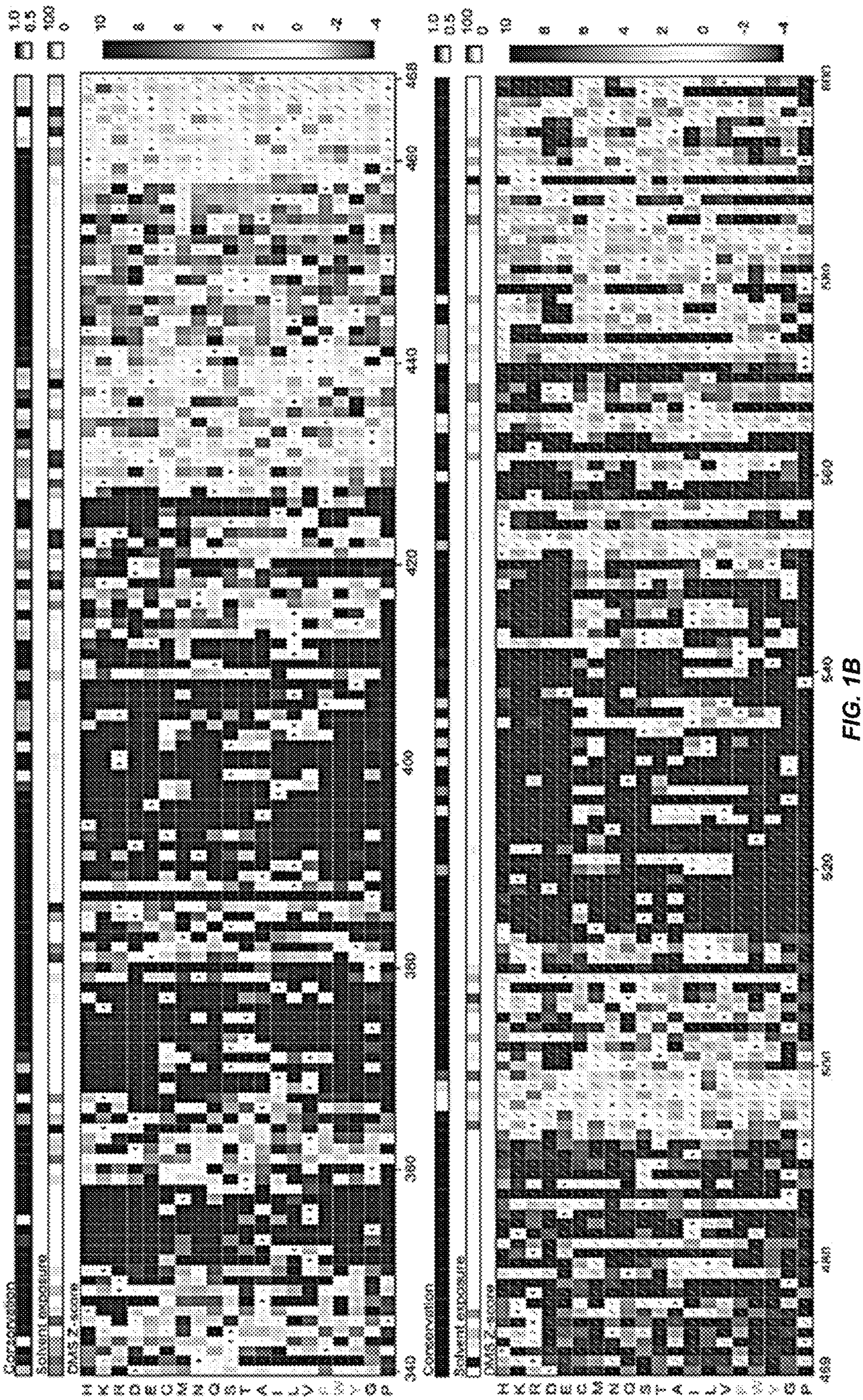

The scans revealed both intrinsic domain properties, and also several mutations that enhanced RNA editing (FIGS. 1B, 2A). Specifically: 1) As expected, most mutations in conserved regions 442-460 and 469-495 that bind the RNA duplex near the editing site led to a significant decrease in editing efficiency of the enzyme; 2) However, mutating the negatively charged E488 residue, which recognizes the cytosine opposite the flipped adenosine by donating hydrogen bonds, to a positively charged or most polar-neutral amino acids resulted in an improvement in editing efficiency. This is consistent with the previously discovered E488Q mutation which has been shown to improve the catalytic activity of the enzyme; 3) Furthermore, most mutations to residues that contact the flipped adenosine (V351, T375, K376, E396, C451, R455) were observed to be detrimental to enzyme function; 4) Similarly, the residues of the ADAR2-DD that interact with the zinc ion in the active site and the inositol hexakisphosphate (R400, R401, K519, R522, S531, W523, D392, K483, C451, C516, H394 and E396) were all also extremely intolerant to mutations. 5) Additionally, surface exposed residues in general readily tolerated mutations as compared to buried residues.

To independently validate the results from the DMS, 33 mutants from the DMS whose editing efficiencies ranged from very low to very high as compared to the wild-type ADAR2-DD were individually examined. The mutants were assayed for their ability to repair a premature amber stop codon (UAG) in the cypridina luciferase (cluc) transcript. The majority of the mutants (85%) followed the same trend in the arrayed validations as seen in the pooled screens (FIG. 2B). Additionally, the efficiency of variants in the ADAR2-DD DMS at editing UAG triplets was compared to published mutants and again similar agreement in the activity of a majority of the variants (75%) was observed, together confirming the efficacy of the deep mutational scan.

Enhancing Functionality of the ADAR2 Deaminase Domain.

Building on this platform (FIG. 1A), domain variants were screened that expanded functionality, in particular focusing on mining mutants that improved editing at refractory RNA motifs such as adenosines flanked by a 5' guanosine. Towards this, two HEK293FT clonal cell lines were created with MS2-adRNAs targeting 5' and 3' GAC sites integrated into them. A screen was carried out in cell lines harboring these MS2-adRNAs by transducing them with the corresponding MCP-ADAR2-DD(E488Q) libraries at a low MOI (0.2-0.4), evaluating the potential of 3287 mutants to edit a GAC motif. Similar to above, following lentiviral transduction and selection, RNA was extracted, reverse transcribed, and relevant regions of the deaminase domain amplified, sequenced and analyzed (FIG. 2C). A novel mutant N496F that enhanced editing at a 5'-GA-3' motif was identified by this method. Interestingly, in the ADAR2-DD crystal structure, the N496 residue is in close proximity to the adenosine on the unedited strand that base pairs with the 5' uracil flanking the target adenosine (FIG. 2D). This mutant was validated using a cluc luciferase reporter bearing a premature opal stop codon (UGA) and confirmed that the N496F, E488Q double mutant was 3-fold better at restoring luciferase activity as compared to E488Q alone (FIG. 2E). To further confirm that the N496F, E488Q double mutant could be used to efficiently edit adenosines flanked by a 5' guanosine, the ability of this mutant to edit a GAC and GAG motif in the 3' UTR and CDS of the endogenous RAB7A and KRAS transcripts respectively was examined. The double mutant N496F, E488Q was 2.5-fold more efficient at editing the GAC motif and 1.5-fold more efficient at editing a GAG motif than the E488Q (FIG. 2E, FIG. 7), together confirming the ability of this novel screening format to discover variants that expand the deaminase domain functionality.

Improving Specificity Via Splitting of the ADAR2 Deaminase Domain.

In addition to increasing the on-target activity of ADARs at editing adenosines in non-preferred motifs, another challenge towards unlocking their utility as a RNA editing toolset is that of improving specificity. Due to their intrinsic dsRNA binding activity, overexpression of ADARs leads to promiscuous transcriptome wide off-targeting, and thus, when relying on exogenous ADARs, it is important to engineer restriction of the catalytic activity of the overexpressed enzyme only to the target mRNA. It was hypothesized that it might be possible to achieve this by splitting the deaminase domain into two catalytically inactive fragments that come together to form a catalytically active enzyme only at the intended target (FIG. 3A). The MS2 Coat Protein (MCP) and Lambda N (λN) systems have been used to efficiently recruit ADARs, thus, these systems were used to recruit the two split halves, i.e. the N- and C-terminal fragments of the ADAR2-DD. Specifically, constructs were created with cloning sites for N-terminal fragments located downstream of the MCP while those for the C-terminal fragments located upstream of the λN. Chimeric adRNAs were designed to bear a BoxB and a MS2 stem loop along with an antisense domain complementary to the target. Studying the sequence-function map of the ADAR2-DD generated from the DMS (FIG. 1B) as well as its crystal structure 18 putative regions were identified for splitting the protein (FIG. 3B). The resulting 18 different split-ADAR2 pairs were assayed for their ability to repair a premature amber stop codon (UAG) in the cypridina luciferase (cluc) transcript in the presence of the recruiting adRNA bearing BoxB and MS2 stem loops (FIG. 3*c*). Of these pairs 9-12 showed the best editing efficiency, and notably were all located within residues 465-468 which have low conservation scores across species. Interestingly, this region is flanked by highly conserved amino acids (442-460 and 469-495).

Every component of the split-ADAR2 system was essential for RNA editing. Specifically, all components and pairs of components were assayed for their ability to restore luciferase activity. The MCP-ADAR2-DD was included as a control. Restoration of luciferase activity was observed when every component of the split-ADAR2 system was delivered, confirming that the individual components lacked enzymatic activity (FIG. 8A). Additionally, the importance of fragment orientation was also confirmed for the formation of a functional enzyme. Towards this, the positions of the N- and C-terminal fragments were switched to create ADAR2-$DD_N$-MCP and λN-ADAR2-$DD_C$ in addition to the working MCP-ADAR2-$DD_N$ and ADAR2-$DD_C$-λN pair. Each pair of N- and C-terminal fragments wads then tested. Functionality was observed only for the MCP-ADAR2-$DD_N$ paired with ADAR2-$DD_C$-λN (FIG. 8B).

Since MCP and λN are proteins of viral origin these molecules were replaced with the human TAR Binding Protein (TBP) and the Stem Loop Binding Protein (SLBP) respectively to create a humanized split-ADAR2 system with improved translational relevance. In the presence of a chimeric adRNA containing a histone stem loop and a TAR stem loop, restoration of luciferase activity was observed (FIG. 3D). This also confirmed that the split-ADAR2 pair 12 (hereinafter referred to as ADAR2-$DD_N$ and ADAR2-$DD_C$) could indeed be recruited for RNA editing using two independent sets of protein-RNA binding systems.

Experiments were performed to investigate the specificity profiles via analysis of the transcriptome-wide off-target A-to-G editing effected by this system (FIGS. 4A-B and FIGS. 9-10). Each condition from FIG. 4A (where the endogenous RAB7A transcript was targeted) was analyzed by RNA-seq. From each sample, ~19 million uniquely aligned sequencing read pairs were obtained. Fisher's exact test was used to quantify significant changes in A-to-G editing yields, relative to untransfected cells, at each reference adenosine site having sufficient read coverage. Notably, utilizing the split-ADAR2 system observed a 1100-1400 fold reduction in the number of off-targets as compared to the MCP-ADAR2 system. Excitingly, the specificity profiles of the split-ADAR2 system were comparable to those seen when using endogenous recruitment of ADARs via long antisense RNA (FIGS. 9-10).

Figure 4C:
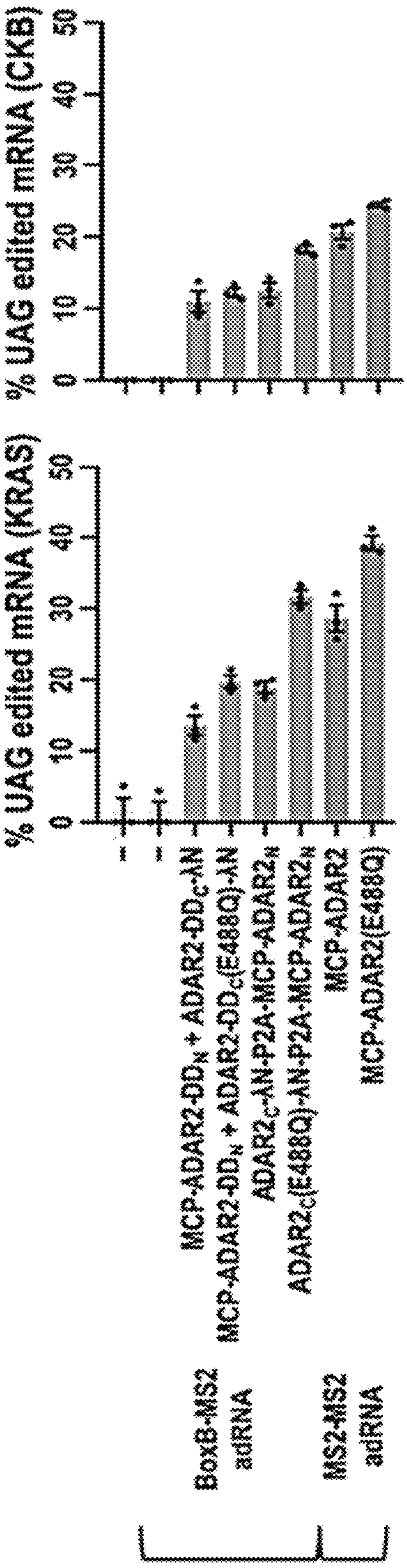

To confirm generalizability of the results, the split-ADAR2 was tested at two additional endogenous loci: an adenosine in the 3'UTR of CKB and an adenosine in the CDS of KRAS, and observed robust editing efficiency of the split-ADAR2 system (FIGS. 4A and 4C). To enable convenient delivery of the split-ADAR2 system an all-in-one vector was created bearing a bicistronic ADAR2-$DD_C$-λN-P2A-MCP-ADAR2-$DD_N$ which also enabled higher editing efficiencies across all three loci tested (FIGS. 4A and C). The entire split-ADAR2 system consisting of CMV promoter driven ADAR2-$DD_C$-λN-P2A-MCP-ADAR2-$DD_N$ and a human U6 promoter driven BoxB-MS2 adRNA is ~3500 bp in size and can easily be packaged into a single adeno-associated virus (AAV).

Figure 4D:
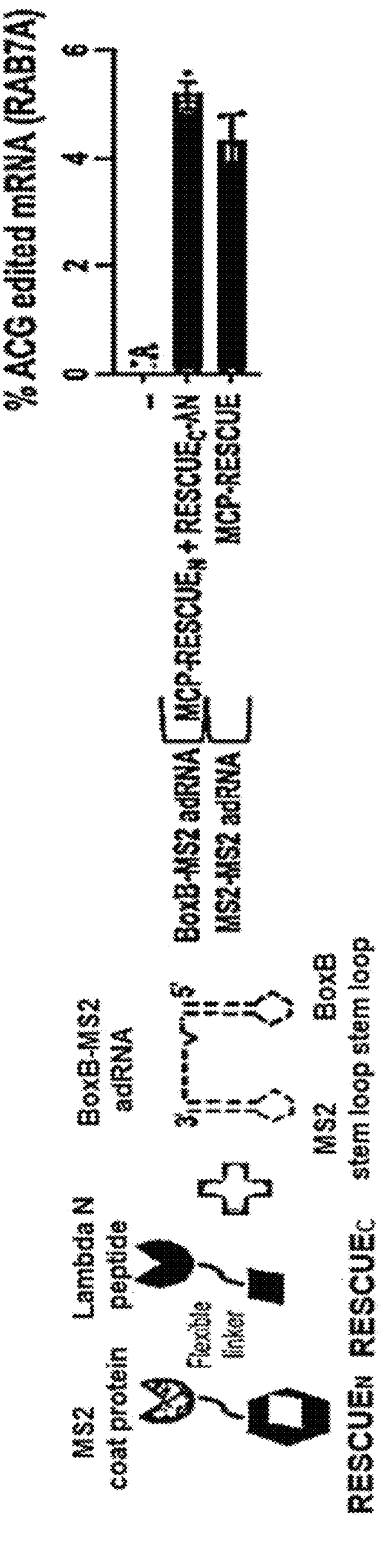

To test if the split-ADAR2 chassis could be expanded to enable new functionalities, specifically C-to-U editing, a split-RESCUE system was created and confirmed comparable C-to-U RNA editing of the endogenous RAB7A transcript as the full-length MCP-RESCUE (FIG. 4D).

It will be understood that various modifications may be made without departing from the spirit and scope of this disclosure. Accordingly, other embodiments are within the scope of the following claims.

SEQUENCE LISTING (108 sequences)

SEQ ID NO: 1 - DNA, 2106 bp, Homo sapiens
  CDS (1)..(2106)
atggatatagaagatgaagaaaacatgagttccagcagcactgatgtgaaggaaaaccgcaatctggacaacgtgtcccccaaggatggcagcacacctgggcctggcgagggctctcagctctccaatgggggtggtggtggccccggcagaaagcggcccctggaggagggcagcaatggccactccaagtaccgcctgaagaaaaggaggaaaacaccagggcccgtcctccccaagaacgccctgatgcagctgaatgagatcaagcctggtttgcagtacacactcctgtcccagactgggcccgtgcacgcgcctttgtttgtcatgtctgtggaggtgaatggccaggtttttgagggctctggtcccacaaagaaaaaggcaaaactccatgctgctgagaaggccttgaggtctttcgttcagtttcctaatgcctctgaggcccacctggccatggggaggaccctgtctgtcaacacggacttcacatctgaccaggccgacttccctgacacgctcttcaatggttttgaaactcctgacaaggcggagcctcccttttacgtgggctccaatggggatgactccttcagttccagcggggacctcagcttgtctgcttccccggtgcctgccagcctagcccagcctcctctccctgtcttaccaccattcccacccccgagtgggaagaatcccgtgatgatcttgaacgaactgcgcccaggactcaagtatgacttcctctccgagagcggggagagccatgccaagagcttcgtcatgtctgtggtcgtggatggtcagttctttgaaggctcggggagaaacaagaagcttgccaaggcccgggctgcgcagtctgccctggccgccatttttaacttgcacttggatcagacgccatctcgccagcctattcccagtgagggtcttcagctgcatttaccgcaggttttagctgacgctgtctcacgcctggtcctgggtaagtttggtgacctgaccgacaacttctcctcccctcacgctcgcagaaaagtgctggctggagtcgtcatgacaacaggcacagatgttaaagatgccaaggtgataagtgtttctacaggaacaaaatgtattaatggtgaatacatgagtgatcgtggccttgcattaaatgactgccatgcagaaataatatctcggagatccttgctcagatttctttatacacaacttgagctttacttaaataacaaagatgatcaaaaaagatccatctttcagaaatcagagcgaggggggtttaggctgaaggagaatgtccagtttcatctgtacatcagcacctctccctgtggagatgccagaatcttctcaccacatgagccaatcctggaagaaccagcagatagacacccaaatcgtaaagcaagaggacagctacggaccaaaatagagtctggtgaggggacgattccagtgcgctccaatgcgagcatccaaacgtgggacggggtgctgcaaggggagcggctgctcaccatgtcctgcagtgacaagattgcacgctggaacgtggtgggcatccagggatccctgctcagcattttcgtggagcccatttacttctcgagcatcatcctgggcagcctttaccacggggaccacctttccagggccatgtaccagcggatctccaacatagaggacctgccacctctctacaccctcaacaagcctttgctcagtggcatcagcaatgcagaagcacggcagccagggaaggcccccaacttcagtgtcaactggacggtaggcgactccgctattgaggtcatcaacgccacgactgggaaggatgagctgggccgcgcgtcccgcctgtgtaagcacgcgttgtactgtcgctggatgcgtgtgcacggcaaggttccctcccacttactacgctccaagattaccaagcccaacgtgtaccatgagtccaagctggcggcaaaggagtaccaggccgccaaggcgcgtctgttcacagccttcatcaaggcggggctgggggcctgggtggagaagcccaccgagcaggaccagttctcactcacgccctga

SEQ ID NO: 2 - protein, 701 aa, Homo sapiens
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGEGTIPVRSNASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 3 - DNA, 3681 bp, Homo sapiens
  CDS (1)..(3681)
atgaatccgcggcaggggtattccctcagcggatactacacccatccatttcaaggctatgagcacagacagctcaggtaccagcagcctgggccaggatcttcccccagtagtttcctgcttaagcaaatagaatttctcaaggggcagctcccagaagcaccggtgattggaaagcagacaccgtcactgccaccttccctcccaggactccggccaaggtttccagtactacttgcctccagtaccagaggcaggcaagtggacatcaggggtgtccccaggggcgtgcatctcagaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccaaaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagaggtaaccccagtgacaggggccagtctcagaagaactatgctcctcctctcaaggtccccagaagcacagccaaagacactccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatag

SEQ ID NO: 4 - protein, 1226 aa, Homo sapiens
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLRSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGEGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 5 - DNA, 2796 bp, Homo sapiens
  CDS (1)..(2796)
atggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccaaaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcgatttaaattccaggttgtcatcaatggccgagagtttcccccagctgaagctggaagcaagaaagtggccaagcaggatgcagctatgaaagccatgacaattctgctagaggaagccaaagccaaggacagtggaaaatcagaagaatcatcccactattccacagagaaagaatcagagaagactgcagagtcccagacccccaccccttcagccacatccttcttttctgggaagagccccgtcaccacactgcttgagtgtatgcacaaattggggaactcctgcgaattccgtctcctgtccaaagaaggccctgcccatgaacccaagttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagttcgtttaccaagcaaaagttgggggtcgctggttcccagccgtctgcgcacacagcaagaagcaaggcaagcaggaagcagcagatgcggctctccgtgtcttgattggggagaacgagaaggcagaacgcatgggtttcacagaggtaaccccagtgacaggggccagtctcagaagaactatgctcctcctctcaaggtccccagaagcacagccaaagacactccctctcactggcagcaccttccatgaccagatagccatgctgagccaccggtgcttcaacactctgactaacagcttccagccctccttgctcggccgcaagattctggccgccatcattatgaaaaaagactctgaggacatgggtgtcgtcgtcagcttgggaacagggaatcgctgtgtgaaaggagattctctcagcctaaaaggagaaactgtcaatgactgccatgcagaaataatctcccggagaggcttcatcaggtttctctacagtgagttaatgaaatacaactcccagactgcgaaggatagtatatttgaacctgctaagggaggagaaaagctccaaataaaaaagactgtgtcattccatctgtatatcagcactgctccgtgtggagatggcgccctctttgacaagtcctgcagcgaccgtgctatggaaagcacagaatcccgccactaccctgtcttcgagaatcccaaacaaggaaagctccgcaccaaggtggagaacggagaaggcacaatccctgtggaatccagtgacattgtgcctacgtgggatggcattcggctcggggagagactccgtaccatgtcctgtagtgacaaaatcctacgctggaacgtgctgggcctgcaaggggcactgttgacccacttcctgcagcccatttatctcaaatctgtcacattgggttaccttttcagccaagggcatctgacccgtgctatttgctgtcgtgtgacaagagatgggagtgcatttgaggatggactacgacatccctttattgtcaaccaccccaaggttggcagagtcagcatatatgattccaaaaggcaatccgggaagactaaggagacaagcgtcaactggtgtctggctgatggctatgacctggagatcctggacggtaccagaggcactgtggatgggccacggaatgaattgtcccgggtctccaaaaagaacatttttcttctatttaagaagctctgctccttccgttaccgcagggatctactgagactctcctatggtgaggccaagaaagctgcccgtgactacgagacggccaagaactacttcaaaaaaggcctgaaggatatgggctatgggaactggattagcaaaccccaggaggaaaagaacttttatctctgcccagtatag

SEQ ID NO: 6 - protein, 931 aa, Homo sapiens
MAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGEGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 7 - DNA, 459 bp, Artificial Sequence
  N-terminal ADAR2 sequence for split ADAR
  CDS (1)..(459)
cagctgcacctgccccaggttctcgcagacgccgtatcccgccttgtactgggcaagtttggtgatcttactgacaatttttcatctcctcatgcgaggcggaaagtactcgcaggcgtcgtcatgacgaccggaactgacgtgaaagacgccaaagtcatctctgtctccacgggcacaaagtgcataaacggggagtacatgagcgaccgggggctggcactgaatgattgtcacgctgaaataatatctaggcgatctctgcttagatttctctacactcaactcgaattgtaccttaacaacaaagatgaccagaaacgcagtatatttcagaaatcagaacgcggcggatttcgacttaaggaaaacgttcagttccacttgtatatcagcacatccccttgcggtgacgcccgaatcttttccccgcacgagccgatattggaggagcccgcg

SEQ ID NO: 8 - protein, 153 aa, Artificial Sequence
  Synthetic Construct
QLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPA

SEQ ID NO: 9 - DNA, 702 bp, Artificial Sequence
  C-terminal ADAR2 sequence for split ADAR
  CDS (1)..(702)
atggacagacatcctaataggaaggctagaggccaacttcggacgaagattgaaagtggcgagggtactatcccggtgcggtccaacgctagtattcaaacgtgggacggagtccttcaaggtgaacggctgttgacaatgagctgctcagacaaaatcgcgcgctggaatgtagtgggaatccaaggcagcctcttgagcatattcgtagaacccatatatttctcatccattattttgggctctctgtatcatggtgaccatctgtcaagggctatgtaccaacgaatttctaatatcgaggatcttcctccactctatacactcaataagcctctcttgtccgggatatcaaacgctgaggcccgccagccagggaaagctcctaacttcagtgttaactggaccgttggtgattctgcgatagaggtcatcaacgccacgacaggtaaggatgagctcggtagagcctcacgcctgtgtaaacacgcgttgtattgtagatggatgagagtacatgggaaggtcccatctcacttgctccgaagcaagatcactaagcctaatgtgtatcatgagtcaaaactcgcggctaaagaataccaggcagccaaagctcgactttttacagcttttattaaggcagggctcggggcatgggtcgagaagccgaccgagcaggaccaattctctctgacgccc

SEQ ID NO: 10 - protein, 234 aa, Artificial Sequence
  Synthetic Construct
MDRHPNRKARGQLRTKIESGEGTIPVRSNASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 11 - DNA, 351 bp, Artificial Sequence
  Coat protein coding sequence
  CDS (1)..(351)
atggcgtccaatttcactcagtttgtgctggttgacaacggcgggaccggggacgttacggtagccccctcaaactttgccaacggtatagcggagtggataagcagcaattctaggagtcaagcatacaaagttacatgcagcgtgcgccaatctagcgctcagaatcgcaagtacaccattaaagtagaggtccccaagggagcctggagaagctatcttaacatggagttgaccataccaatcttcgctaccaactctgactgtgaactcattgtgaaagccatgcaaggtctgctcaaggatggtaacccaattccgtccgctatcgctgccaactctgggatttac

SEQ ID NO: 12 - protein, 117 aa, Artificial Sequence
  Synthetic Construct
MASNFTQFVLVDNGGTGDVTVAPSNFANGIAEWISSNSRSQAYKVTCSVRQSSAQNRKYTIKVEVPKGAWRSYLNMELTIPIFATNSDCELIVKAMQGLLKDGNPIPSAIAANSGIY

SEQ ID NO: 13 - RNA, 18 nt, Artificial Sequence
  RNA Hairpin that interacts with MS2 coat protein
acaugaggauuacccaug

SEQ ID NO: 14 - RNA, 18 nt, Artificial Sequence
  Hairpin loop that binds to MS2 protein
acaugaggaucacccaug

SEQ ID NO: 15 - DNA, 63 bp, Artificial Sequence
  LambdaN peptide
  CDS (1)..(63)
aatgcgaggacacggcgacgagaacgacgcgctgaaaagcaagcgcaatggaaagctgcaaac

SEQ ID NO: 16 - protein, 21 aa, Artificial Sequence
  Synthetic Construct
NARTRRRERRAEKQAQWKAAN

SEQ ID NO: 17 - DNA, 63 bp, Artificial Sequence
  LambdaN peptide
  CDS (1)..(63)
aatgctcggactcggagacgcgagcggagagcggagaagcaggcacaatggaaagccgctaat

SEQ ID NO: 18 - protein, 21 aa, Artificial Sequence
  Synthetic Construct
NARTRRRERRAEKQAQWKAAN

SEQ ID NO: 19 - DNA, 63 bp, Artificial Sequence
  LambdaN peptide
  CDS (1)..(63)
aacgcgagaacccgccgacgagagcgcagagcggagaaacaagcacagtggaaggcggccaac

SEQ ID NO: 20 - protein, 21 aa, Artificial Sequence
  Synthetic Construct
NARTRRRERRAEKQAQWKAAN

SEQ ID NO: 21 - DNA, 63 bp, Artificial Sequence
  LambdaN peptide
  CDS (1)..(63)
aatgcccgaacccgacgaagggaaagacgggctgagaaacaggctcaatggaaagcggctaat

SEQ ID NO: 22 - protein, 21 aa, Artificial Sequence
  Synthetic Construct
NARTRRRERRAEKQAQWKAAN

SEQ ID NO: 23 - RNA, 15 nt, Artificial Sequence
  nutL BoxB
gcccugaagaagggc

SEQ ID NO: 24 - RNA, 15 nt, Artificial Sequence
  nutR BoxB
gcccugaaaaagggc

SEQ ID NO: 25 - protein, 127 aa, Artificial Sequence
  PP7 peptide
SKTIVLSVGEATRTLTEIQSTADRQIFEEKVGPLVGRLRLTASLRQNGAKTAYRVNLKLDQADVVDCSTSVCGELPKVRYTQVWSHDVTIVANSTEASRKSLYDLTKSLVVQATSEDLVVNLVPLGR

SEQ ID NO: 26 - RNA, 25 nt, Artificial Sequence
  PP7 targeted hairpin
uaaggaguuuauauggaaacccuua

SEQ ID NO: 27 - protein, 14 aa, Artificial Sequence
  BIV Tat peptide domain
RRRGTRGKGRRIRR

SEQ ID NO: 28 - RNA, 28 nt, Artificial Sequencd
  TAR element
ggcucguguagcucauuagcuccgagcc

SEQ ID NO: 29 - protein, 701 aa, Artificial Sequence
  ADAR polypeptide sequence
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGEGTIPVRSFASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 30 - protein, 701 aa, Artificial Sequence
  ADAR Polypeptide sequence
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGQGTIPVRSFASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 31 - protein, 701 aa, Artificial Sequence
  ADAR Polypeptide Sequence
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGHGTIPVRSFASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 32 - protein, 701 aa, Artificial Sequence
  ADAR Polypeptide Sequence
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGRGTIPVRSFASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 33 - protein, 701 aa, Artificial Sequence
  ADAR Polypeptide Sequence
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGKGTIPVRSFASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 34 - protein, 701 aa, Artificial Sequence
  ADAR Polypeptide Sequence
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGNGTIPVRSFASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 35 - protein, 701 aa, Artificial Sequence
  ADAR Polypeptide Sequence
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGAGTIPVRSFASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 36 - protein, 701 aa, Artificial Sequence
  ADAR Polypeptide Sequence
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGMGTIPVRSFASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 37 - protein, 701 aa, Artificial Sequence
  ADAR Polypeptide Sequence
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGSGTIPVRSFASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 38 - protein, 701 aa, Artificial Sequence
  ADAR Polypeptide Sequence
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGFGTIPVRSFASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 39 - protein, 701 aa, Artificial Sequence
  ADAR Polypeptide Sequence
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGLGTIPVRSFASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 40 - protein, 701 aa, Artificial Sequence
  ADAR Polypeptide Sequence
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGWGTIPVRSFASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 41 - protein, 701 aa, Artificial Sequence
  ADAR Polypeptide Sequence
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGEGTIPVRSYASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 42 - protein, 701 aa, Artificial Sequence
  ADAR Polypeptide Sequence
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGQGTIPVRSYASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 43 - protein, 701 aa, Artificial Sequence
  ADAR Polypeptide Sequence
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGHGTIPVRSYASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 44 - protein, 701 aa, Artificial Sequence
  ADAR Polypeptide Sequence
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGRGTIPVRSYASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 45 - protein, 701 aa, Artificial Sequence
  ADAR Polypeptide Sequence
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGKGTIPVRSYASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 46 - protein, 701 aa, Artificial Sequence
  ADAR Polypeptide Sequence
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGNGTIPVRSYASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 47 - protein, 701 aa, Artificial Sequence
  ADAR Polypeptide Sequence
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGAGTIPVRSYASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 48 - protein, 701 aa, Artificial Sequence
  ADAR Polypeptide Sequence
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGMGTIPVRSYASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 49 - protein, 701 aa, Artificial Sequence
  ADAR Polypeptide Sequence
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGSGTIPVRSYASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 50 - protein, 701 aa, Artificial Sequence
  ADAR Polypeptide Sequence
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGFGTIPVRSYASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 51 - protein, 701 aa, Artificial Sequence
  ADAR Polypeptide Sequence
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGLGTIPVRSYASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 52 - protein, 701 aa, Artificial Sequence
  ADAR Polypeptide Sequence
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGWGTIPVRSYASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 53 - protein, 701 aa, Artificial Sequence
  ADAR Polypeptide Sequence
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGQGTIPVRSNASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 54 - protein, 701 aa, Artificial Sequence
  ADAR Polypeptide Sequence
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGHGTIPVRSNASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 55 - protein, 701 aa, Artificial Sequence
  ADAR Polypeptide Sequence
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGRGTIPVRSNASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 56 - protein, 701 aa, Artificial Sequence
  ADAR Polypeptide Sequence
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGKGTIPVRSNASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 57 - protein, 701 aa, Artificial Sequence
  ADAR Polypeptide Sequence
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGNGTIPVRSNASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 58 - protein, 701 aa, Artificial Sequence
  ADAR Polypeptide Sequence
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGAGTIPVRSNASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 59 - protein, 701 aa, Artificial Sequence
  ADAR Polypeptide Sequence
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGMGTIPVRSNASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 60 - protein, 701 aa, Artificial Sequence
  ADAR Polypeptide Sequence
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGSGTIPVRSNASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 61 - protein, 701 aa, Artificial Sequence
  ADAR Polypeptide Sequence
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGFGTIPVRSNASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 62 - protein, 701 aa, Artificial Sequence
  ADAR Polypeptide Sequence
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGLGTIPVRSNASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 63 - protein, 701 aa, Artificial Sequence
  ADAR Polypeptide Sequence
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSESGESHAKSFVMSVVVDGQFFEGSGRNKKLAKARAAQSALAAIFNLHLDQTPSRQPIPSEGLQLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGWGTIPVRSNASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLTP

SEQ ID NO: 64 - protein, 1226 aa, Artificial Sequence
  ADAR Polypeptide Sequence
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLRSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGEGTIPVESFDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 65 - protein, 1226 aa, Artificial Sequence
  ADAR Polypeptide Sequence
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLRSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGQGTIPVESFDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 66 - protein, 1226 aa, Artificial Sequence
  ADAR Polypeptide Sequence
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLRSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGHGTIPVESFDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 67 - protein, 1226 aa, Artificial Sequence
  ADAR Polypeptide Sequence
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLRSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGRGTIPVESFDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 68 - protein, 1226 aa, Artificial Sequence
  ADAR Polypeptide Sequence
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLRSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGKGTIPVESFDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 69 - protein, 1226 aa, Artificial Sequence
  ADAR Polypeptide Sequence
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLRSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGNGTIPVESFDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 70 - protein, 1226 aa, Artificial Sequence
  ADAR Polypeptide Sequence
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLRSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGAGTIPVESFDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 71 - protein, 1226 aa, Artificial Sequence
  ADAR Polypeptide Sequence
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLRSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGMGTIPVESFDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 72 - protein, 1226 aa, Artificial Sequence
  ADAR Polypeptide Sequence
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLRSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGSGTIPVESFDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 73 - protein, 1226 aa, Artificial Sequence
  ADAR Polypeptide Sequence
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLRSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGFGTIPVESFDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 74 - protein, 1226 aa, Artificial Sequence
  ADAR Polypeptide Sequence
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLRSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGLGTIPVESFDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 75 - protein, 1226 aa, Artificial Sequence
  ADAR Polypeptide Sequence
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLRSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGWGTIPVESFDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 76 - protein, 1226 aa, Artificial Sequence
  ADAR Polypeptide Sequence
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLRSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGEGTIPVESYDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 77 - protein, 1226 aa, Artificial Sequence
  ADAR Polypeptide Sequence
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLRSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGQGTIPVESYDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 78 - protein, 1226 aa, Artificial Sequence
  ADAR Polypeptide Sequence
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLRSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGHGTIPVESYDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 79 - protein, 1226 aa, Artificial Sequence
  ADAR Polypeptide Sequence
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLRSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGRGTIPVESYDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 80 - protein, 1226 aa, Artificial Sequence
  ADAR Polypeptide Sequence
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLRSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGKGTIPVESYDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 81 - protein, 1226 aa, Artificial Sequence
  ADAR Polypeptide Sequence
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLRSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGNGTIPVESYDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 82 - protein, 1226 aa, Artificial Sequence
  ADAR Polypeptide Sequence
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLRSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGAGTIPVESYDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 83 - protein, 1226 aa, Artificial Sequence
  ADAR Polypeptide Sequence
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLRSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGMGTIPVESYDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 84 - protein, 1226 aa, Artificial Sequence
  ADAR Polypeptide Sequence
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLRSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGSGTIPVESYDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 85 - protein, 1226 aa, Artificial Sequence
  ADAR Polypeptide Sequence
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLRSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGFGTIPVESYDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 86 - protein, 1226 aa, Artificial Sequence
  ADAR Polypeptide Sequence
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLRSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGLGTIPVESYDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 87 - protein, 1226 aa, Artificial Sequence
  ADAR Polypeptide Sequence
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLRSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGWGTIPVESYDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 88 - protein, 1226 aa, Artificial Sequence
  ADAR Polypeptide Sequence
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLRSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGQGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 89 - protein, 1226 aa, Artificial Sequence
  ADAR Polypeptide Sequence
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLRSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGHGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 90 - protein, 1226 aa, Artificial Sequence
  ADAR Polypeptide Sequence
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLRSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGRGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 91 - protein, 1226 aa, Artificial Sequence
  ADAR Polypeptide Sequence
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLRSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGKGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 92 - protein, 1226 aa, Artificial Sequence
  ADAR Polypeptide Sequence
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLRSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGNGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 93 - protein, 1226 aa, Artificial Sequence
  ADAR Polypeptide Sequence
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLRSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGAGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 94 - protein, 1226 aa, Artificial Sequence
  ADAR Polypeptide Sequence
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLRSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGMGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 95 - protein, 1226 aa, Artificial Sequence
  ADAR Polypeptide Sequence
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLRSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGSGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 96 - protein, 1226 aa, Artificial Sequence
  ADAR Polypeptide Sequence
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLRSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGFGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 97 - protein, 1226 aa, Artificial Sequence
  ADAR Polypeptide Sequence
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLRSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGLGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 98 - protein, 1226 aa, Artificial Sequence
  ADAR Polypeptide Sequence
MNPRQGYSLSGYYTHPFQGYEHRQLRYQQPGPGSSPSSFLLKQIEFLKGQLPEAPVIGKQTPSLPPSLPGLRPRFPVLLASSTRGRQVDIRGVPRGVHLRSQGLQRGFQHPSPRGRSLPQRGVDCLSSHFQELSIYQDQEQRILKFLEELGEGKATTAHDLSGKLGTPKKEINRVLYSLAKKGKLQKEAGTPPLWKIAVSTQAWNQHSGVVRPDGHSQGAPNSDPSLEPEDRNSTSVSEDLLEPFIAVSAQAWNQHSGVVRPDSHSQGSPNSDPGLEPEDSNSTSALEDPLEFLDMAEIKEKICDYLFNVSDSSALNLAKNIGLTKARDINAVLIDMERQGDVYRQGTTPPIWHLTDKKRERMQIKRNTNSVPETAPAAIPETKRNAEFLTCNIPTSNASNNMVTTEKVENGQEPVIKLENRQEARPEPARLKPPVHYNGPSKAGYVDFENGQWATDDIPDDLNSIRAAPGEFRAIMEMPSFYSHGLPRCSPYKKLTECQLKNPISGLLEYAQFASQTCEFNMIEQSGPPHEPRFKFQVVINGREFPPAEAGSKKVAKQDAAMKAMTILLEEAKAKDSGKSEESSHYSTEKESEKTAESQTPTPSATSFFSGKSPVTTLLECMHKLGNSCEFRLLSKEGPAHEPKFQYCVAVGAQTFPSVSAPSKKVAKQMAAEEAMKALHGEATNSMASDNQPEGMISESLDNLESMMPNKVRKIGELVRYLNTNPVGGLLEYARSHGFAAEFKLVDQSGPPHEPKFVYQAKVGGRWFPAVCAHSKKQGKQEAADAALRVLIGENEKAERMGFTEVTPVTGASLRRTMLLLSRSPEAQPKTLPLTGSTFHDQIAMLSHRCFNTLTNSFQPSLLGRKILAAIIMKKDSEDMGVVVSLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGWGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNFYLCPV

SEQ ID NO: 99 - DNA, 24 bp, Artificial Sequence
  Synthetic Sequence
ccatagatggagacagcggattca

SEQ ID NO: 100 - DNA, 24 bp, Artificial Sequence
  Synthetic Sequence
ccatagatggagacagcggctaca

SEQ ID NO: 101 - DNA, 24 bp, Artificial Sequence
  Synthetic Sequence
ccatagatggaggcagcggctaca

SEQ ID NO: 102 - DNA, 24 bp, Artificial Sequence
  Synthetic Sequence
ccatggatggagacagcggctaca

SEQ ID NO: 103 - DNA, 25 bp, Artificial Sequence
  Synthetic Sequence
grgaacctccgatagaccagacaag

SEQ ID NO: 104 - DNA, 25 bp, Artificial Sequence
  Synthetic Sequence
gtgctcctccgatggaccagacaag

SEQ ID NO: 105 - DNA, 25 bp, Artificial Sequence
  Synthetic Sequence
gtgctcctccgatggaccagacaag

SEQ ID NO: 106 - DNA, 25 bp, Artificial Sequence
  Synthetic Sequence
gtgctcctccgatagaccaggcaag

SEQ ID NO: 107 - DNA, 31 bp, Artificial Sequence
  Synthetic Sequence
tattctgtacagtagacacaagaattatgta

SEQ ID NO: 108 - DNA, 31 bp, Artificial Sequence
  Synthetic Sequence
ttgggaaatccagctagcggcagtattctgt

What is claimed is:

1. An engineered polypeptide comprising:

an ADAR2 catalytic domain that comprises a sequence that is at least 95% identical to SEQ ID NO: 2 and comprises a E488X1 mutation and a N496X2 mutation, wherein the mutations are relative to SEQ ID NO:2, wherein X1 is Q, H, R, K, N, A, M, S, F, L, or W and X2 is F or Y.

2. The engineered polypeptide of claim 1, wherein the sequence is SEQ ID NO: 2 and has the E488X1 mutation and a N496X2 mutation, wherein the mutations are relative to SEQ ID NO:2, wherein X1 is Q, H, R, K, N, A, M, S, F, L, or W and X2 is F or Y.

3. The engineered polypeptide of claim 1, wherein the engineered polypeptide performs a chemical modification to a nucleotide.

4. The engineered polypeptide of claim 1, further comprising one or more additional mutations, wherein the mutations are relative to SEQ ID NO:2, selected from the group consisting of: G336D, G487A, G487V, T490C, T490S, V493T, V493S, V493A, V493R, V493D, V493P, V493G, N597K, N597R, N597A, N597E, N597H, N597G, N597Y, A589V, S599T, N613K, N613R, N613A, and N613E of SEQ ID NO: 2.

5. The engineered polypeptide of claim 1, further comprising one or more additional mutations, wherein the mutations are relative to SEQ ID NO:2, at R348, V351, T375, K376, E396, C451, R455, N473, R474, K475, R477, R481, S486, T490, S495, or R510.

6. A composition comprising:

(a) a polynucleotide encoding the engineered polypeptide of claim 1; and (b) a polynucleotide comprising a guide RNA or a polynucleotide encoding the guide RNA, wherein the guide RNA comprises a guide sequence having a degree of complementarity with a target RNA.

7. The composition of claim 6, wherein the engineered polypeptide further comprises a tethering moiety that is operably linked to the engineered polypeptide.

8. The composition of claim 7, wherein the tethering moiety comprises: a Cas protein, a MS2 coat protein peptide, a PP7 peptide, a LambdaN peptide, a tet peptide, a programmable PUF domain, or a combination thereof.

9. A composition comprising at least one vector comprising a polynucleotide encoding the engineered polypeptide of claim 1.

10. The composition of claim 9, wherein at least one vector further comprises a polynucleotide encoding a guide RNA, wherein the guide RNA comprises a sequence having a degree of complementarity with a target RNA.

11. The composition of claim 9, wherein the at least one vector comprises a retroviral vector, an adenovirus vector, an adeno-associated virus vector (AAV), a recombinant AAV, an alphavirus vector, a lentivirus, or a combination thereof.

12. The composition of claim 9, wherein the at least one vector comprises a polynucleotide encoding for a tethering moiety.

13. The composition of claim 12, wherein the tethering moiety is selected from the group consisting of: a Cas protein, a MS2 coat protein peptide, a PP7 peptide, a LambdaN peptide, a tet peptide, and a programmable PUF domain.

14. An engineered polypeptide comprising:

an ADAR2 catalytic domain that comprises a sequence that is at least 95% identical to SEQ ID NO: 2 from amino acid 316 to amino acid 697 of SEQ ID NO: 2 and having a E488X1 mutation and a N496X2 mutation, wherein the mutations are relative to SEQ ID NO:2, wherein X1 is Q, H, R, K, N, A, M, S, F, L, or W and X2 is F or Y.

15. The engineered polypeptide of claim 14, wherein the engineered polypeptide performs a chemical modification to a nucleotide.

16. The engineered polypeptide of claim 14, wherein the engineered polypeptide further comprises a tethering moiety that is operably linked to the engineered polypeptide.

17. The engineered polypeptide of claim 14, further comprising an N-terminus that has a sequence that is at least 95% identical to SEQ ID NO: 2 from amino acid 1-315.

18. The engineered polypeptide of claim 14, further comprising a C-terminus that has a sequence that is at least 95% identical to SEQ ID NO: 2 from amino acid 698-701.

19. The engineered polypeptide of claim 14, wherein the engineered polypeptide comprises the E488Q mutation and the N496F mutation; or the engineered polypeptide comprises the E488Q mutation and the N496Y mutation, wherein the mutations are relative to SEQ ID NO:2.

20. A composition comprising:

(a) a polynucleotide encoding the engineered polypeptide of claim 14; and (b) a polynucleotide encoding a guide RNA, wherein the guide RNA comprises a guide sequence having a degree of complementarity with a target RNA.

21. The composition of claim 20, wherein the polynucleotide encoding the engineered polypeptide further comprises a sequence encoding for a tethering moiety that is operably linked to the engineered polypeptide.

22. The composition of claim 21, wherein the tethering moiety comprises: a Cas protein, a MS2 coat protein peptide, a PP7 peptide, a LambdaN peptide, a tet peptide, a programmable PUF domain, or a combination thereof.

23. A composition comprising at least one vector comprising: a polynucleotide encoding the engineered polypeptide of claim 14.

24. The composition of claim 23, wherein the at least one vector further comprises a polynucleotide encoding a guide RNA, wherein the guide RNA comprises a sequence having a degree of complementarity with a target RNA.

25. The composition of claim 23, wherein the at least one vector comprises a retroviral vector, an adenovirus vector, an adeno-associated virus vector (AAV), a recombinant AAV, an alphavirus vector, a lentivirus, or a combination thereof.

26. A method of treating a disease or a disorder in a subject, the method comprising:

administering to the subject the composition of claim 6, wherein the administering deaminates an adenosine in a target RNA sequence, thereby treating the disease or disorder in the subject.

27. A method of treating a disease or a disorder in a subject, the method comprising:

administering to the subject the composition of claim 20, wherein the administering deaminates an adenosine in a target RNA sequence, thereby treating the disease or disorder in the subject.

28. A composition comprising:

an engineered polypeptide or a polynucleotide encoding for the engineered polypeptide, wherein the engineered polypeptide comprises:

an ADAR2 catalytic domain that comprises a sequence that is at least 95% identical to SEQ ID NO: 2 from amino acid 316 to amino acid 465 of SEQ ID NO: 2;

a second domain of ADAR2 that comprises a sequence that is at least 95% identical to SEQ ID NO: 2 from amino acid 466 to amino acid 701;

an E488X1 mutation, wherein X1 is Q, H, R, K, N, A, M, S, F, L, or W; and a N496X2 mutation, wherein X2 is F or Y, wherein the mutations are relative to SEQ ID NO:2.

* * * * *